United States Patent 12,746,261 (PROBIOTIC BACILLUS COMPOSITIONS AND METHODS OF USE) - sequence listing, part 9

SEQ ID NO: 12 - DNA, 1000000 bp, Bacillus subtilis
atggaaaatatattagacctgtggaaccaagcccttgctcaaatcgaaaaaaagttgagcaaaccgagttttgagacttggatgaagtcaaccaaagcccactcactgcaaggcgatacattaacaatcacggctcccaatgaatttgccagagactggctggagtccagatacttgcatctgattgcagatactatatatgaattaaccggggaagaattgagcattaagtttgtcattcctcaaaatcaagatgttgaggactttatgccgaaaccgcaagtcaaaaaagcggtcaaagaagatacatctgattttcctcaaaatatgctcaatccaaaatatacttttgatacttttgtcatcggatctggaaaccgatttgcacacgctgcttccctcgcagtagcggaagcacccgcgaaagcttacaaccctttatttatctatgggggcgtcggcttagggaaaacgcacttaatgcatgcgatcggccattatgtaatagatcataatccttctgccaaagtggtttatctgtcttctgagaaatttacaaacgaattcatcaactctatccgagataataaagccgtcgacttccgcaatcgctatcgaaatgttgatgtgcttttgatagatgatattcaatttttagcggggaaagaacaaacccaggaagaatttttccatacatttaacacattgcacgaagaaagcaaacaaatcgtcatttcaagtgatcgaccgccaaaggaaattccgacacttgaggacagattgcgctcacgttttgaatggggacttattacagatatcacaccgcctgatctagaaacgagaattgcgattttaagaaaaaaagccaaagcagaaggcctcgatattccgaacgaggttatgctttacatcgcgaatcaaatcgacagcaatattcgggaactcgaaggagcattaatcagagttgtcgcttattcatctttaattaataaagatattaatgctgatctggccgctgaggcgttgaaagatattattccttcctcaaaaccgaaagtcattacgataaaagaaattcagagggtagtaggccagcaatttaatattaaactcgaggatttcaaagcaaaaaaacggacaaagtcagtagcttttccgcgtcaaatcgccatgtacttatcaagggaaatgactgattcctctcttcctaaaatcggtgaagagtttggaggacgtgatcatacgaccgttattcatgcgcatgaaaaaatttcaaaactgctggcagatgatgaacagcttcagcagcatgtaaaagaaattaaagaacagcttaaatagcaggaccggggatcaatcggggaaagtgtgaataacttttcggaagtcatacacagtctgtccacatgtggataggctgtgtttcctgtctttttcacaacttatccacaaatccacaggccctactattacttctactattttttataaatatatatattaatacattatccgttaggaggataaaaatgaaattcacgattcaaaaagatcgtcttgttgaaagtgtccaagatgtattaaaagcagtttcatccagaaccacgattcccattctgactggtattaaaattgttgcatcagatgatggagtatcctttacagggagtgactcagatatttctattgaatccttcattccaaaagaagaaggagataaagaaattgtcactattgaacagcccggaagcatcgttttacaggctcgcttttttagtgaaattgtaaaaaaattgccgatggcaactgtagaaatcgaagtccaaaatcagtatttgacgattatccgttctggtaaagctgaatttaatctaaacggactggatgctgatgagtatccgcacttgcctcagattgaagagcatcatgcgattcagatcccaactgatttgttaaaaaatctaatcagacaaacagtatttgcagtgtccacctcagaaacacgccctatcttgacaggtgtaaactggaaagtggagcaaagtgaattattatgcactgcaacggatagccaccgtcttgcattaagaaaggcaaaacttgatattccagaagacagatcttataacgtcgtgattccgggaaaaagtttaactgaactcagcaagattttagatgacaaccaagaacttgtagatatcgtcatcacagaaacccaagttctgtttaaagcgaaaaacgtcttattcttctcacggcttctggacgggaattatccagacacaaccagcctgattccgcaagacagcaaaacagaaatcattgtgaacacaaaagaattccttcaggccattgatcgtgcatctcttttagctagagagggacgcaacaacgttgtaaaactgtccgcaaaaccggctgaatccattgaaatttcttccaactccccggaaatcggtaaagttgtggaagcaattgctgcggatcaaattgaaggtgaggaattaaatatctcttttagtccaaaatatatgctggatgcactaaaggtgcttgaaggagcagaaatacgcgtaagctttacaggcgcaatgagacctttcttaattcgcacgccgaatgatgaaacgattgtacagcttatcctccctgtcagaacctattaatccgatacactgctgccgacccgtcggcagcttttctattcggtatctgctccgacaagttttccctttccctaattcgtttttttttagtacaattagatattagtgatatttgaaagaggtcgatataatggcaaatccgatttcaattgatacagagatgattacactcggacaattcttaaaattagccgatgtgattcagtctggcggtatggcgaagtggtttttaagcgagcatgaagtgcttgtgaacgatgagccggacaaccgccggggcagaaaactgtatgttggagatgtggtagagattgaaggatttggttcatttcaagtcgtcaattaaagcgggtgacactgattgtatatccagaacttagaactgacatcttaccgcaactacgaccatgctgaacttcaatttgaaaataaagtaaatgtgatcatcggagaaaacgcccaggggaagacaaacctcatggaggcgatctatgtcttgtccatggcgaaatcgcaccggacatcaaatgacaaagaacttatacggtgggacaaagactatgctaaaatagagggaagagtgatgaagcaaaacggggcgatcccgatgcagctcgtcatctccaaaaagggtaaaaagggcaaggtcaatcatattgaacagcaaaagctcagccagtatgtcggagccctcaacaccattatgttcgcgccggaagatttaaatcttgtaaagggaagccctcaagtgagaaggcggtttcttgacatggaaatcggacaggtttctctcgtctaccttcatgatctttctctttaccagaaaatcctttcccagcggaatcattttttgaaacagctgcaaacaagaaaacaaactgaccggacgatgctcgatgttctgaccgatcagcttgtagaagttgcagcaaaagtcgtcgtaaaacgcctgcagtttacagcacagctcgagaaatgggcgcagcccatccatgcaggcatctcaagagggcttgaagaactgaccctgaaataccatacagctcttgaggtatcagatcccctagatttgtcgaaaataggagatagctatcaagaagcgttttctaaattaagagaaaaagaaattgagcgtggtgtgacgctgtcagggcctcatcgcgatgatgttcttttctatgtgaacggacgcgatgtgcagacgtatggttctcaaggacagcagcgaacgacggcgttgtcccttaagctggcggagattgacctgatccatgaagaaatcggagaatatcccattttactattggatgatgtactgagtgaactggatgattatcgccagtcacacttgcttcatacgatccaaggccgtgtacaaacgtttgtcacaacgacaagcgttgatggcattgatcacgaaaccttacgtcaagcaggaatgttccgtgtgcaaaatggtgcgttagtgaagtgaagaaatgaggtgagcaattgtatattcatttaggtgatgactttgtggtttcaacacgagatattgtcggcatttttgactttaaagccaacatgtcgcctattgttgaagaatttctgaaaaaacagaaacacaaggtggtgcctttcgtaaacggcacgcccaaatctatcgtagtcacggttcagaatatatattactctcccttatcttccagcacattaaaaaaacgtgcgcaatttatgtttgaaatagattcttagaaattttttatcacgaatatatcgtttagaaaagtgtaggtgaatgacgtggctatggaacagcagcaaaacagttatgatgaaaatcagatacaggtactagaaggattggaagctgttcgtaaaagaccggggatgtatatcggttcgacaaacagcaaaggccttcaccacctggtatgggaaattgtcgacaatagtattgacgaagccctcgccggttattgtacggatatcaatatccaaatcgaaaaagacaacagtatcacggttgtagataatggccgcggtattccagtcggtattcatgaaaaaatgggccgtcctgcggtagaagtcattatgacggtacttcatgccggaggaaaatttgacggaagcggctataaagtatccggaggattacacggtgtaggtgcgtctgtcgtaaacgcactatcaacagagcttgatgtgacggttcaccgtgacggtaaaattcaccgccaaacttataaacgcggagttccggttacagaccttgaaatcattggcgaaacggatcatacaggaacgacgacacattttgtcccggaccctgaaattttctcagaaacaaccgagtatgattatgatctgcttgccaaccgcgtacgtgaattagcctttttaacaaagggcgtaaacatcacgattgaggataaacgtgaaggacaagagcgcaaaaatgaataccattacgaaggcggaattaaaagttatgtagagtatttaaaccgctctaaagaggttgtccatgaagagccgatttacattgaaggcgaaaaggacggcattacggttgaagtggctttgcaatacaatgacagctacacaagcaacatttactcgtttacaaacaacattaacacgtacgaaggcggtacccatgaagctggcttcaaaacgggcctgactcgtgttatcaacgattacgccagaaaaaaagggcttattaaagaaaatgatccaaacctaagcggagatgacgtaagggaagggctgacagcgattatttcaatcaaacaccctgatccgcagtttgagggccaaacgaaaacaaagctgggcaactcagaagcacggacgatcaccgatacgttattttctacggcgatggaaacatttatgctggaaaatccagatgcagccaaaaaaattgtcgataaaggcttaatggcggcaagagcaagaatggctgcgaaaaaagcccgtgaactaacacgtcgtaagagtgctttggaaatttcaaacctgcccggtaagttagcggactgctcttcaaaagatccgagcatctccgagttatatatcgtagagggtgactctgccggaggatctgctaaacaaggacgcgacagacatttccaagccattttgccgcttagaggtaaaatcctaaacgttgaaaaggccagactggataaaatcctttctaacaacgaagttcgctctatgatcacagcgctcggcacaggtattggggaagacttcaaccttgagaaagcccgttaccacaaagttgtcattatgacagatgccgatgttgacggcgcgcacatcagaacactgctgttaacgttcttttacagatatatgcgccaaattatcgaaaatggctacgtgtacattgcgcagccgccgctctacaaggttcaacaggggaaacgcgttgaatatgcgtacaatgacaaggagctggaagagctgttaaaaactcttcctcaaacgcctaagcctggactgcagcgttacaaaggtcttggtgaaatgaatgccacccagctatgggagacaaccatggatcctagttccagaacacttcttcaggtaactcttgaagatgcaatggatgcggacgagacttttgaaatgcttatgggcgacaaggtagaaccgcgccgaaacttcatagaagcgaatgcgagatacgttaaaaatcttgacatctaatcataaaaagccttatttccaataagaaataaggcttttttctgaacaagatcagatgcagcaatgcttgcagtacctatatattctagcaatttaatgtgtataatcataagtttattgatataatggagaatagtgaaatcgtattgaaggtcataatggacaatctactcccacatatttcatgtgatacttcagggaggttttttaatgagtgaacaaaacacaccacaagttcgtgaaataaatatcagtcaggaaatgcgtacgtccttcttggattatgcaatgagcgttatcgtgtcccgtgctcttccagatgttcgagacggtttaaaaccggttcatagacggattttgtatgcaatgaatgatttaggcatgacaagtgacaagccttataaaaaatccgcgcgtatcgttggagaagttatcgggaaataccacccgcacggtgattcagcggtatatgaatccatggtcagaatggctcaggatttcaactaccgttatatgctcgttgacggtcacggaaacttcggttctgttgacggagactcagcggcggccatgcgttatacagaagcaagaatgtctaaaatctcaatggagattcttcgcgacatcacaaaagacacaatcgattaccaggataactatgacgggtcagaaagagaacctgtcgttatgccttcaaggttcccgaatctgctcgtgaacggtgctgccggcattgcggtaggtatggcaacaaacattcctccgcaccagctgggagaaatcattgacggtgtacttgctgtcagtgagaatccggacattacaattccagagcttatggaagtcattccagggcctgatttcccgaccgcgggtcaaatcttgggacgcagcggtatccggaaagcatacgaatcaggccgaggctctatcacgatccgggcaaaagctgagatcgaacaaacatcttcgggtaaagaaagaattatcgttacagagttaccttaccaagtaaataaggctaaattaattgagaaaattgcagatctcgtaagggacaaaaagatagagggtatcacagatctgcgtgatgagtcagatcgtacaggtatgagaattgtcattgaaatcagacgcgacgccaatgcaaatgtcatcttaaacaatctgtacaaacaaactgctctacaaacatcttttggcatcaacctgcttgcacttgttgatggccagccgaaagttttaactcttaagcaatgcctggagcattacctcgaccatcaaaaagttgtcattagacgccgtactgcttatgaattgcgtaaagcggaagcgagagctcatatcctggaaggattgagagttgcactggatcatctcgatgcagttatctcccttatccgtaattctcaaacggctgaaattgcgagaacaggtttaattgaacaattctcactgacagagaagcaagcacaagcgatccttgatatgaggctccagcgtttaacgggactggaacgtgaaaagatagaagaagaataccaatctcttgttaaattaattgcagagctaaaagacatcttggcaaatgaatataaagtgcttgagatcattcgtgaagaactcacggaaatcaaagagcgttttaacgatgaaagacgtactgagatcgtcacttctggactggagactattgaagatgaagatctcatcgagagagaaaatatcgtagttactctgacgcacaacggatacgtcaaacgtcttcctgcatcaacttaccgcagtcaaaaacgaggcggaaaaggtgtacaaggtatgggaacaaacgaagatgatttcgttgagcatttgatctctacgtcaactcatgacacgattctcttcttctcgaacaaggggaaagtgtatcgtgcaaaagggtatgaaatccctgaatacggcagaacggcaaaaggaatcccgattattaacctgctggaggtagaaaagggtgagtggatcaacgcgattattccagtcacggaattcaatgcggagctttaccttttcttcactacaaagcatggggtttcaaaacgaacatcgctatctcaattcgctaatatccgcaacaatggtctaatcgctctgggtcttcgtgaagatgatgaactgatgggtgtacgtctgactgacggcacaaaacaaatcatcattggaacgaaaaacggtttactgatccgtttccctgaaacagatgtccgggagatgggaagaactgcggcgggcgtaaaaggcatcaccctgacggatgacgacgttgttgtcggcatggagatattagaggaagaatcacacgtccttatcgtaactgaaaaagggtacggaaaacgaactccggctgaagagtacagaacccaaagccggggcggaaaaggactcaaaacagcgaaaatcaccgagaacaacggccaactagtagcagtgaaagctactaaaggtgaagaggatctaatgattattacagctagcggcgtactcatcagaatggacatcaatgatatctccatcaccggacgtgtcactcaaggtgtgcgtctcatcagaatggcagaagaagagcatgttgctacagtagctttagtagagaaaaacgaagaagatgagaatgaagaagaacaagaagaagtgtgagaaaaagcgcagctgaaatagctgcgcttttttgtgtcataaccctttacagtcataaaaattatggtataatcatttttgttgtctttttaaagacacaagcatgaccattatgactagtaaaaacttttttaaaaaagtattgacctagttaactaaaaatgttactattaagtagtcgcttcgagagaagcacacaaagttctttgaaaactaaacaagacaaaacgtacctgttaattcatttttaaaaatcgcacagcgatgtgcgtagtcagtcaaactagggcctgcacgacgcaggtcacacaggtgtcgccgcaggatgcggtgaacttaacctgtgatccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgaggcacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggaactttgttccttgaataagttaagatgggcctgtagctcagctggttagagcgcacgcctgataagcgtgaggtcggtggttcgagtccactcaggcccaccatcttatataacggggccttagctcagctgggagagcgcctgctttgcacgcaggaggtcagcggttcgatcccgctaggctccaccaacgtgttctttgaaaactagataacagtagacatcacattcaattagtaatacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcaagcttaaacccagctcattgagctgggttttttgtttgttaaaaatgaagaagaaactgtgaagcgtatttagggaatttattttctgatactaataaaaactgctgaattaacacgtagtcatcacttatatgctgtgttaataactcataccaccattctgtttcataccttgcaatcatcccaacgttgtacaaaatcaaataatgaattgtcatttcgggaagcctcagaaattgctccctttgagaagggatataatattggttcttttccatgtcaaacaataagctggtcgatgtccatggctccttgtcttgtggtgaaatttcgaacagcagcccgtgttcatttttttttgtaaaagaccattgataatgatgggacatgtattcagcaaaccttgaatcagacattttgtaattgattactacttcctccggtataaaaatttcgttcttatccttctcaacttttgtcataaatcgttctttctgctgaaagtagaaaatatcgctaagttctggaatggccattaataattttttcatggtataccgttcatctactatatccgattgtccaaataaatgtttcataaaatgtacgcataggccattccgttgtattttcacttcatcgtcgctaaaacaataattttgtttctttcgttttcttgttgttacgccatgtgccagtactgatgtatggcttggataatgaggatcacgtgtaattaagcatgctttgataagctgtgccattccataaaataaaagaatcggtttgatttctaagggagaatatgcagcttgtttataaaacgattcggcatgctttaagaaataaataaaccgttcactgtttttaaaagagttttttttcgcatcgtcaataccgtttaagatataaaccttttctagaaatttctgggttgattcaacggagtaaaatagcgctaagtctttccactcatgatatgtcatgtatatttcttaatcctttccgttatctaaatatttcaactctttcccgcttccttgacatgctcttggctagttgataatctacatataatattttgccgaaaagagggggatttactaatgtgggaaagtaaattttcaaaagaaggcttaacgttcgacgatgtgctgcttgtaccagcaaagtctgaggtacttccgcgtgatgtggatttatctgtagaacttacaaaaacgttaaagctaaatattcctgtcatcagcgcaggtatggacactgtaacagaatcagcaatggcaattgcaatggcaagacagggcggcttgggcatcattcacaaaaatatgtccattgaacagcaggctgaacaagttgataaagtaaagcgttctgagcgcggcgttatcacaaatcccttctttttaactcctgatcaccaagtatttgatgcggagcatttgatggggaaatacagaatttccggtgttccgattgtaaataacgaagaagaccagaagcttgttggaattattacaaaccgtgaccttcgttttatttctgactactcaatgaaaatcagcgacgtcatgacgaaagaagagctagttactgcatctgtaggaactactctggatgaagctgaaaagattttgcagaaacataaaattgaaaagcttcctctcgtagatgaccagaataaattaaaaggtcttatcacaattaaagacattgaaaaagtcattgagttcccgaactcatctaaagacattcacggccgcctgatcgttggcgcggcagttggtgtaactggcgatacaatgactcgcgtcaaaaagcttgttgaagccaatgttgatgtgattgttatcgatacagctcacggacactctcaaggcgttttaaacacagtcacaaaaattcgtgaaacgtatcccgaattaaacattattgctggaaacgtggcaacagctgaagcgacaagagcgcttatcgaagctggagcagacgttgtcaaagttggaataggacctggttcaatttgtactacacgtgttgtagccggcgtcggtgttccgcaaattacagcaatttatgattgtgcgactgaagcaagaaaacacggcaaaacaatcatagccgatggtgggattaaattctctggcgatatcactaaagcgttggcagccggcggacatgctgttatgctcggaagcttgcttgcaggcacatctgaaagccctggtgaaactgaaatctatcaaggcagaagatttaaggtataccgcggcatgggatcagttgctgcaatggaaaaaggaagtaaagaccgttacttccaagaagaaaacaaaaaatttgttcctgaaggaattgaaggacgcacaccttacaaagggccagttgaagaaaccgtttatcagctagtcggaggccttcgttctggtatggggtattgcgggtccaaagatctgcgtgcgctaagagaagaagctcagttcattcgcatgactggcgcaggacttcgcgaaagccatccgcatgacgtacagattacaaaagaatcacctaactatacaatttcataataaattgttacaaattaaaaacatttgacagggtctctgactctgtctattttttttatactgattatgataaaatttatactgttgtgcattgaaaatgtccttaacggcttaattatagatgaagaaaatgaaatacggaggtcgtacgattgaacatcaagaaatgtaaacagctactgatgtcattggttgtgttaactctagctgtcacgtgtctggctccaatgtcaaaagcaaaagcagccagcgatccaattgatatcaatgcatctgctgctattatgatcgaagcttcttcaggtaaaattctttacagtaaaaatgcagataagagactgccaattgcgagtatgacaaaaatgatgacagagtatctgttattagaagcaattgatcaaggtaaagtgaaatgggaccaaacctatacgcctgatgactatgtgtatgaaatttcccaagataacagcttatcaaacgttcctcttcggaaagacgggaaatacacagtaaaagaattatatcaagctacagcaatttattctgcaaatgctgctgctattgcaattgcagaaatcgttgccggttctgaaactaagtttgttgaaaaaatgaatgcaaaagcaaaagaactaggcttaacagattacaaatttgttaacgcaacaggtcttgaaaacaaagatcttcacgggcatcagcctgaggggacaagcgtaaatgaagaaagtgaagtttctgcaaaggatatggcaattcttgcggatcacttgattactgactaccctgagatactggagacttccagtatcgccaaaacgaaattcagagaaggcaccgatgatgaaatggacatgccgaactggaattttatgctgaaggggcttgtcagcgagtataaaaaagcgactgtagacggactgaaaacaggttctactgactctgcgggttcatgctttacaggaacagctgaacgcaacggtatgcgtgtcatcactgttgttttaaacgcgaagggcaaccttcatacaggccgtttcgatgaaacgaaaaaaatgtttgattatgctttcgacaatttctccatgaaagaaatttatgctgaaggcgatcaagtaaaaggccataaaacaatttcagttgataagggtaaagagaaagaagtaggcattgtgacaaacaaggcgttctctcttcctgtcaaaaatggtgaagaaaagaattacaaagcgaaggtcacactgaataaagacaacttaactgctcctgtgaaaaaaggaaccaaggttgggaagctgactgcggaatacacaggtgatgaaaaggattacggattccttaacagcgatctggctggcgtagaccttgttacaaaagaaaatgtagaaaaagcaaactggtttgttttgacaatgcgcagtatcggcggattttttgccggaatttggggaagcattgttgatacggtaaccggctggttttaatcaattgaaagagctctgatggatgttagggctctttcgcgtaatatactgaaaaaacccaatttttaataaaaaatgattttcaaagcgctaaaaaccgaataaaatagtatatatccatatgaattattggatttctaggatacaataaggattagaaatcatataactataccttgattagggggaccaagaaatggctcaaacaggtactgaacgtgtaaaacgcggaatggcagaaatgcaaaaaggcggcgtcatcatggacgtcatcaatgcggaacaagcgaaaatcgctgaagaagctggagctgtcgctgtaatggcgctagaacgtgtgccagcagatattcgcgcggctggaggagttgcccgtatggctgaccctacaatcgtggaagaagtaatgaatgcagtatctatcccggtaatggcaaaagcgcgtatcggacatattgttgaagcgcgtgtgcttgaagctatgggtgttgactatattgatgaaagtgaagttctgacgccggctgacgaagaatttcatttaaataaaaatgaatacacagttccttttgtctgtggctgccgtgatcttggtgaagcaacacgccgtattgcggaaggtgcttctatgcttcgcacaaaaggtgagcctggaacaggtaatattgttgaggctgttcgccatatgcgtaaagttaacgctcaagtgcgcaaagtagttgcgatgagtgaggatgaactaatgacagaagcgaaaaatctaggtgctccttacgagcttcttcttcaaattaaaaaagacggcaagcttcctgtcgttaactttgccgctggcggtgtagcaactccagctgatgctgctctcatgatgcagctcggtgctgacggagtatttgttggttctggtattttcaaatcagacaaccctgctaaatttgcgaaagcaattgtggaagcaacaactcactttactgattacaaattaatcgctgagttgtcaaaagagcttggtactgcaatgaaagggattgaaatctcaaacttacttccagaacagcgtatgcaagaacgcggctggtaagaacataggagcgctgctgacatgttaacaataggtgtactaggacttcaaggagcagttagagagcacatccatgcgattgaagcatgcggcgcggctggtcttgtcgtaaaacgtccggagcagctgaacgaagttgacgggttgattttgccgggcggtgagagcacgacgatgcgccgtttgatcgatacgtatcaattcatggagccgcttcgtgaattcgctgctcagggcaaaccgatgtttggaacatgtgccggattaattatattagcaaaagaaattgccggttcagataatcctcatttaggtcttctgaatgtggttgtagaacgtaattcatttggccggcaggttgacagctttgaagctgatttaacaattaaaggcttggacgagccttttactggggtattcatccgtgctccgcatattttagaagctggtgaaaatgttgaagttctatcggagcataatggtcgtattgtagccgcgaaacaggggcaattccttggctgctcattccatccggagctgacagaagatcaccgagtgacgcagctgtttgttgaaatggttgaggaatataagcaaaaggcacttgtataaaacagttgaaagctgtggaaacttatagtacattataagcacaaataaagatcgaaaagcgttgataggaactagtagggagcctctctttctaagagagccgatggttggtgcgaatcggtgaaagatgctgtctgaatccatccttgagcgaaatgctgaagcgagtaggcatttacgggataaccgttatgtttgaaagtggaaaacgagtctttgatttgttttcaatcagggtggcaacgcgagagctctcgtccctttatggggatgagggctctttttattttcgataaatcaataaaaaaaggagtgtttcgcatgcttgatacgaaaatgctgagagcaaattttcaagaaattaaagcaaagcttgtacacaaaggcgaagacttaactgattttgataagtttgaggcgctggatgatagacgaagagagcttatcggcaaggttgaagagttaaaaggaaaacgaaatgaagtttctcagcaggttgctgtgctgaagcgtgagaaaaaagacgcggatcacattattaaagcaatgcgtgaagtcggcgaggaaattaaaaagctcgatgaagaattacggacagtggaagctgagcttgatacaatcctgctctcaatcccgaatattccgcatgagtctgtacctgtcggtgaaacagaagacgacaacgtagaagtgcgtaaatggggtgaaaagccttcatttgcttatgagccgaagccgcactgggatattgcggatgagctgggtattctggattttgaacgtgctgccaaagtaacaggaagccgtttcgtgttctataaaggcttaggtgctcgtctggagcgtgcgctttataactttatgcttgatctgcatgtggatgagtataactacactgaagtgatcccgccatatatggtaaaccgcgcaagcatgacgggaacggggcagcttcctaaatttgaagaggatgcatttaaaatcagagaagaagattatttcttaattccaacggcggaagtgccgattacaaacatgcatcgcgatgaaatcctttcaggtgacagcctgccgatcaactatgcggcattcagtgcttgcttccgttctgaagctggttcagcaggacgtgacacacgcggattaattcgtcagcaccaatttaataaagttgagcttgtaaagtttgtgaagcctgaagattcttatgaagaattagagaaacttacaaaccaagcagaacgggttcttcagctgcttgagcttccataccgtgtcatgagcatgtgtacgggtgacttaggctttacggctgcgaaaaaatacgatatcgaagtttggattccaagccaagacacatatcgagaaatctcttcttgcagcaacttcgaagcgttccaggcgagacgtgcgaatattcgtttcagacgtgaagctaaaggcaagcctgagcatgtacacacactgaacggttcaggactggcggttggaagaacagttgccgctatcttagaaaattatcagcaggaagacggaagcgttgtgattccgaaagtgctccgtccttatatggggaatagagaagtaatgaaaccgtaaattatggaaaggcgtgcctgacaaggtgcgcctttttgcttatgtaaacacggcattttcataaaaacaaaaaaagtttttaaaaatgcttgaccacacgagaacatacgtgatatagtaagtcttgtcgatacggaggaatacccaagtccggctgaagggatcggtcttgaaaaccgacaggggtgtcaaagcccgcgggggttcgaatccctcttcctccgccatattgattttaattctaatgaaacacaagcatatattggagattgttttgtccgttgcattcggtgcggcggattttttattttaaagaaaaagtgaatctcgactgagattcactttttttgattatcatgaataactgaagcaatttgatctacaatattttcaatcgagttttcgtcgttcagaagatcataatcttcaatgcgaagttttaaaacagggcaggcattaaaaccgcttatccagttctcgtagcgtgtatgcatttcttcccaataagacctgcttgtctgaagctccatctcacggccgcgttgttcaatccggtttaaaatgttctccagatctccttctaaatagatcagcacatctgggtgtgggaaatacggtgtcattaccattgcttcgaaaaggcttgtgtaagtcttataatcaacctttgacattgtccctttatcagcatgcatttttgcgaaaattcctgtatcttcataaatcgaacgatcctgtacaaaacctccgccggcttcaaaaattgttttctgttctttgaagcgttcagctaagaagtaaatttgaaggtgaaagctccaacgttcaaaatcatgatagaacttttccaagtatggattatgatcgacttcctccaaagatgttttaaatccaagccgtttagctaaagtttttgttaaagtcgattttccgacacctactgttcctgctactgtaataattgaattcttagggatatgatgttccttcatacgataagctcctttacatgggcggcaatgcgttcaaagtcgctcttattcaaaacgaaatcctttgaatcaccatctacggttaacactgtaagttcagggtctgcttcctgcagctgcttgatggcgacttcataatctgaaatcagctgctccaaatagctagtttcaatttttttctcaaaggggcgcccgcgtttttcaatgcggtgtagcaatgtaggcagactggcctttatgtaaatgatgaaattcggctttggcagatcatccgttagcaggtgatatatctttttgtatttttccagctgatgtggagacaaggtgcgttccgcaaaaatcacatttttataaatatgataatcagctattacaggctgtcccttttttaaaaagtgatcactggtgtcttcaagctgtttgtatctgtgacaaagaaaaaacatctcgagctggaagctccattcctctatattgtcataaaacttatcaaggtacgggttatcctctacaatctcattgatcatagggaatccgaattcttgtgagagcatcgttgcgagagttgtttttcctgccccgataggaccttctattgcaataaaaggggctgtattcatcggaatcctccttatatctgaaaaacgtgcgtcagttaccgaccttcatattgtatcacaacccttgggtgcccccatgaaaaaagacgtttccaaattatcgaaacgtctttttgacaacattaaattgatcagacagcagcagccagttttgtggaaaggaaagacccagcttccaatagctgatgcctcttaaattcagctctttaatcagattaaattttgcttgaatcgagcgggcatcctcgaaccatacctcgtgccttctgttttctgcatcagtatagcggaagaaaggagcttgagcggtttggtcatactgaatggaagcattgttctgatcagctatgacaatggcttgctgagggcttactgctcttgctggagttccccctgctgtatatggcagcgtccagtcatatccatataaattctggcccatgacaattttgttcgcaggcatttcagtcaaagcatattctatgacatcacggacaggtccaattggagaaaccgcttgaggcggcccgccgctatagccccattcatatgtcatgagaacaacaaagtcgacaatttggccatgcgccctgtaatcatgagcttcataccatctgccctgctgtgttgcacttgttttaggagcaagtgccgtagaaatttctaagccctctcgatgaaaaagatcccttgcttcgcggagaaattgattataggcctctctatcctggggccgcaaatattcaaagtcgaaatgaatgtcacggaagccatatctcttggcattctccactatttcatttagaagccttctttttacagtttcgtcgttcaaaaggatccggccaagttcatcactaaatgcctggttttctaggttcgttataatcatcatcaatgttgtattttgactttctgtaatgctccttaaattcgttaaaggcggtgcgactaaggttccgttccgctgtgcctggaagctgaatgcgccaaggtacgttaagtagggcgacgcttctctggccgcctgctggagattttcgctgacttgatttcctcggggctccaaataagcatttgattcgatgtctcgtttaggggctggtgggatgtatatacggaaaccaatctgaagcacggtatttaactggatgcggttaacccttgcgagctcggctgctgttgtattgaactgccgggcgatggatgtcagggtatcacctcgcttcacatcatagaactggccggctattggaatgacaatggtttgtccgacaacaaggctgtcgggattcggtatttcattcgtttcagtgatctcatttgcggttgttctgtattgtgaagcgatagcagaaagagtgtcgccttgttttaccacataaatttgaatgaaaaacgcctcctttcatatcgctatcaatgtatgaaagaaaagcgctgatcatgtttatttttctgtaatttgttcttccgtcgtaatttctgcgaaaagaacattctccatcatagttaaggcgaattcgttatcttcgtcactgtttgacgcgatacagtccttaggaatcgtgatgctgtattccctcatataagcgtcattagcggtaaacagcacacatatattgccggctatacctgttaagataatatgtctcacctgcaactcagtaagaagggtgtgaagtgcagtttcgtagaaagcggaatgttttggtttgattaaaaaataatcagcatcttccggggctatcttagtgatgatatccttgcttctttcatttgtgcattcttgctgaatgtttttaatgtcagcttgccaaagtccataatgatcattgatgtaaataatcggccattcattttgtctcgcgtgctcctttaatgataaaatatgaggaacgattttttctgtttttttagcgagggtttctcccatatcgaattcaaaattattgatcatgtctacaatgagaagggctgtatctgctttggacaatcgacagtctcctttccgtttcagttatagttaatatgtagcctttttaggcaatgaaaaaactttgaaaagagagcttatccttatgacacaagatgaactttatatgaaagaagcaattaaagaagcgaaaaaggctgaagagaaaggtgaagtgccaataggtgcggtgcttgtcgttaatgatgaaattatagcgcgtgcacataatttaagagagactgagcaacgatctattgcccatgcagaaatgcttgtgattgatgaagcgtgtaaggcactgggaacatggcggctggaaggtgcgactctttatgtgacgcttgagccttgtccaatgtgtgctggtgcagtcgtactttctcgagtggaaaaagtggtttttggcgcatttgatccgaaaggcggctgttcaggcacgctaatgaaccttctccaggaggaacgctttaatcatcaggctgaagtggtgagcggtgtacttgaggaagaatgcggcggaatgctcagtgcgtttttcagagaactaagaaaaaagaagaaagctgccaggaaaaacttgtctgaatagtacggttgcaatttttaggggaaacagatatacttaagtgtgcatcgtaatagatgcaacataaaatttgatatttattttgccgtgctaagcggggaggtagcggtgccctgtacctgcaatccgctctagcagggccgaatcccttctcgaggttcgtttactttaaggcctgccttaagtaagtggtgttgacgtttgggtcctgcgcaatgggaattcatgaaccatgtcaggtccggaaggaagcagcattaagtgaaacctctcatgtgccgcagggttgcctgggccgagctaactgcttaagtaacgcttagggtagcgaatcgacagaaggtgcacggtaaatcaatcatcaaattttcagactcacctaatattaggtgagttttttgttatgtaaaaagagcttttggaatcgaaacaaggttcatgtataatgggaatgatgaataacggaggagggcaaacccgtgagttaccaagctttatatcgagtattcaggcctcagcgctttgaagatgtggtcggacaagaacacattacaaaaacgctgcaaaatgcccttttgcaaaaaaagttttctcacgcctatctgttttccgggccaagaggaaccggaaaaaccagtgcagccaaaatatttgctaaggctgtcaactgtgaacatgctcctgttgatgagccatgcaacgaatgtgcggcctgtaaagggataacaaacgggtcaatatccgatgtcatagaaattgacgccgcttctaataacggtgttgatgagattcgtgacattcgcgataaagtgaagtttgccccgtcggccgtcacatataaggtatatatcatagatgaggtgcatatgctttctatcggcgcttttaatgcattactaaaaacattagaagagccgcctgagcattgtattttcatattagcaacaactgaaccacacaaaattcctttaaccattatctctagatgtcagcgttttgactttaaacgaattacctcccaggcgattgtaggccgcatgaataaaattgttgatgctgaacagctgcaagtggaggaaggatcgctggatatcatcgcgagtgctgcagacggagggatgagggatgccctgagccttcttgatcaggccatatcattcagcggcgatatcctgaaagtcgaagatgcgcttttaattacgggtgctgtttctcaattatatatcgggaagcttgcacaatccctgcatgataaaaacgtttctgacgcactggaaacattaaatgaattgcttcagcaaggaaaagatccagctaagctgatagaagatatgattttctatttcagggacatgctgctgtacaaaacagcccctggcttagagggagttcttgagaaagtaaaagttgatgaaacgttccgggaactaagtgaacaaattccggctcaggccctatatgaaatgattgatattctgaacaagagccatcaggaaatgaaatggacaaatcatccgcgtatctttttcgaagtggccgttgtgaagatttgccaaacctcacatcaatctgctgctgatctcccggaagtggatatgctgatgaaaaaaatccagcagctcgaacaggaagtagagcggctcaaaacaacgggcataaaagcagctgcggaaagcccgaaaaaagaagcgccgcgtgtgccaaagggcgggaaatccaattacaaagcgccagtaggcagaattcatgagattttgaaggaagccacaagaccggatcttgatctgctcagaaacagttggggcaagcttcttgctcatctcaaacagcaaaacaaagtatcacatgccgctttactgaatgacagtgaacctgtggctgccggatcggcggcatttgttctgaaattcaaatatgaaattcattgtaaaatggtcgctgaggataacaacggagtccggactaatcttgagcagattttagaatcgatgctcggaaaaagaatggatttgattggcgttccagaagcacaatggggtaaaataagagaagaatttttagaagatcatcagcaggaaaatgaaggatcaaatgaaccggctgaagaagacccgcttattgccgaagcgaaaaagcttgttggagcggatttaattgaaataaaagactaacaaaatgaaagagagtgaatgctatgcgtggcggaatgggtaatatgcaaaaaatgatgaaacaaatgcaaaaaatgcaaaaggacatggcgaaggctcaagaagagcttgcagaaaaggttgttgaaggaactgcaggcggcggtatggtaacagtaaaagcaaacggccaaaaagaaatcctggatgttatcatcaaagaagaagtcgttgatcctgaagatattgatatgcttcaagatttagtgcttgctgcaacgaatgaagctttgaaaaaagttgacgaaatcacaaacgaaacaatgggtcaatttacaaagggaatgaacatgccaggtttattctagggggataaaagaacatgcaatatcctgaaccaatatcaaagctgattgacagctttatgaaattgccagggatcggaccgaaaacagcggttcgtctggctttttttgttctaggtatgaaagaagatgtagtattagattttgcgaaagcattagtaaatgcgaaacgcaacctgacatattgttcagtttgcgggcatattacagatcaggacccttgctatatatgtgaagatacgcgcagggataagtctgttatctgtgttgtgcaagaccctaaggatgttatcgctatggagaaaatgaaggaatacaacggacagtatcacgttcttcacggcgctatttctccaatggacggcatcggaccggaggatattaaaataccagaattgttaaaacgattacaggatgatcaagtgacagaagtgatcctcgcgacaaaccctaatatagaaggggaagcaacggcgatgtatatatcaaggctcctcaagccgtctggtattaagctctcccgtattgcccacggactgcccgtcggcggtgacttggaatatgctgacgaggtcactctttctaaagcacttgaaggaagacgtgaattgtaaggaggaaaaagcgatccatgggttttcttcgcaagaaaacattaagaagagagtttgatgaaaaactaaccgagcagctttttaagcaaaaggaagagtggaacaggcaaaaaaagctggtcgaaaaaagcttagaaccgtctgctgaagtgttatacgaactgaaagtagctgaagcgaagtattttttttacttaagggaagcgaagcagcgaaatttaaaaatcagccggtggaagtaagtggtctaaactcctggatcttctcataagcttgtactagaacaagcgaaggagatgagaagattcatggagcctatttttattattgggattattttaggactggttattcttctttttttatcaggttcaactgcgaagcctttaaagtggatgggcatcacagctgttaaatttgtggcaggtgctttgctgctggtttgtgtaaatatgtttggcggcagtcttggcattcatgtgccgattaatctggttacaacagctatcagcggaattttagggatacccggaatagctgcgttagtcgttattaagcaatttatcatttaattgatattatgtattgacttagacaactgaaggtgttattctaatatacgtcgctgatgacgaacagcttttttgaaaaggaaatgctaaaaagttgttgacagtagcggcggtaaatgttatgataataaagtcgcttaaacgagcggtaaacaaagttctttgaaaactaaacaagacaaaatgtacctgttaattcatttttataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttggctcttataaacagaacgttccctgtcttgtttagttttgaaggaactttgttccttgaataagttaagatgggcctgtagctcagctggttagagcgcacgcctgataagcgtgaggtcggtggttcgagtccactcaggcccaccatcttatataacggggccttagctcagctgggagagcgcctgctttgcacgcaggaggtcagcggttcgatcccgctaggctccaccaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctatacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccacattttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcaagtttaaacccagctcattgagctgggttttttgtttacttaagatcgagaaaatcaaacaaatacaaacaccgagggcttatatagcccatatactgatttaaagtttcaaaaaggtctaaatagtgtatacaatatccgttttaaggggaggctaactgtacggaggtggagaagatggacgaaacagttaaacttaatcatacatgtgtgatttgtgatcaagagaagaatagaggcattcatctttatacgaaattcatatgcttagattgtgagagaaaagtaatttctacatcaacttctgatcctgactatgcgttttacgtaaaaaaactaaagagcattcatacaccgccattatattcatagacctgaaaaggtctttttttgtactcttaataataaaaagaagatgaaacttgtttaaggattgaacgtagtagataataatattaaaactgagtatagacacaggagtcgattatctcatgcagagattttttcactttttgatgtggagtttaactagcagtgcgacttttgttttcattggaatattgagcttttttggtttaaaccagtcgctttttttatctattgtttatgggcttgcttctggagcagccgtatatatagctggcatctggaatgcaagacggttatttcttaaaaagcatgaattgacaggaagagagtatgcttacattaagaaaaacttagaggaagcaaggcagaaaatgatccgtcttaggaaagccttgtttcaggctaaaagcattcaaatgtttaagcaaaatgcagaaatgctaaggattgtgagaaggatttatctcctcaccaaaaaagagccaaagcggttttatcaggcagaacgatttttttatcaaactctcgattcggttgttgaattaacagagaagtatgcttttctatcatctcaccccaaaaaaagcaaagaactttcgatgtcgttaagtgagacacgcatcactcttactaaattgaccaagcgtttagaggaagatttaactcaagtaatgggtgatgaaattgacgagttgcactttgaattagacgcagcaaaacattcattaaagaaataagggaagagggtaagagcgatgaaccgagaccaaagcgaccttcatatagatgaattattggcagatccttttggtggtaacatagagataccaggttcggaggctgtaaaagcagagaaagagcaagtacggcttgttgatgttcttcctgaggaaaacaagaaaaaagcaattcagcttgctggacagattgatcataaaaatatgcaaagcattgtcttatacggttcacaagctcaatctaaactgctgaacttttctcatgatatgattaatcatgttcaaaagaaggatgtcggggaaattggcgaaatacttggagagctgatgaaaaagctggagcaagtaaatcctgatgatctccaatctaagaaaaagggttttttggcacgcatgtttggaagagtatcaagttctcttcaagaggtgctgtctaaataccaaaagaccagtgtgcagatagacaaaatcagcttgaagctggagcactctaaaaatgctttaattagtgacaacaagctgttagagcagttatatgaaaaaaataaagaatattttgccgcgctgaatgtttatattgctgcaggagaactgaagctggaggaattaaaaacaaaaacgattcctgaactgaagcaacaggctgaatcgagtgatcataaccaaatggccgttcaagaggtgaatgatttaattcaatttgctgaccggttagataaaagggtgcatgatttgctgctgagcaggcaaattacaatccaaagtgcaccgcaaatcaggctgattcaaaacacaaaccaagcgttagcagaaaagattcagtcatccattgtgacagcgattccgctatggaaaaatcaagttgccattgcactgacgcttttaaggcagcgcaatgcagtggatgcacaacagaaagtatctgatacaaccaatgagcttttgctgaaaaatgcggagcttttaaaaaccaatacaattgaaactgtacgagcaaatgaacgaggccttgttgatatagataccttaaaaaaggtgcaggaaagcttaataagcacgcttgaagaaacactgactatacaagaagaaggacgaatcaaacgccgtcaggcagaagaagagctgatgatgatggaaggcgacctaaagcaaaagctgcttacaataaaggaaagatagttaccagtaagtctggctttaagttctgtcagaggcacgatataataaggtgtaagaagacacattcaaaggattgttttcatgaacacacctttatataaagcattaattcaacatgcgagaagaaattctcattcatttcatgttccgggacatcacaatggagatgtcttttttgatgacgctaagtcaatattcaatccgcttctcaccattgatgtaactgaactggcaggactggatgatctccatcatccttctggggtgattaaggaagctcaggagcttgccagtcaattatatggatcggcggaaagtttttttctggtaaatggtacgactgtcggaaacttagcgatgattttatctgtttgtgaacctggtgatacaattctggttcaaagaaactgtcataaatctgtatttcatgctgttgatttgtccggtgctgagccggtttatcttgcacctgacgttgattcagcgatgcatgtgcctacgcatgttccgcttggaacaattaaagaggccctggaagcatatccagatgcgaaaggcttggtactgaccaatccgacatattacggacatagtgctgatttgactgagatcattactgaagcccatcattacgggattcctgttttggtcgatgaagcgcatggcgcacattttattttaggtgagccttttccggtctcagctttaaaaatgggggcagatattgttgttcagtcggcccacaaaacgttgcctgccatgacgatgggttcttatttgcatctcaacagcagctgcaggattaacagggatcgggtggcagagtatttaaaccgattacaaagcagcagcccgtcttatccgattatggcttcgttagatattgcccgcgcttatgtacagcatattatagaagaacaaaagctttctgacattctgcagcggatagaaacacttaaacaaacgtttgattcacttacaaatgcagaagctgttaaccctgctaatccactgatcatcacggatccgctaaagctcacaattcgttcaaaacgcggacattctggctatacgctgcaaagcatattagagcgtgccaacatattcactgagcttgctgatgaaaatcaagtactgctcgttctcccattgggaggaaaacggagaataaatgctgaaaccattagaagcattgatgaagagattgagaaaacgcctccggatcaggcgtttgtttctgcagaatggggagtgcagcctgttactgtcttgccttatccaaaaaaggtcttacattcgtttaagaaagaatatgtggactttgaggaagcagctggccggctgaatgcagaagatatcatcccttatcctccgggtatcccgatgattatggcgggagaaagaataacaaaagaaagtgtgcaaaagctcagccgcttgatcagcatgaaaacgcatgttcaagggaatatgaaaatcaaagagaaacaactacttgtttatatagaagaggagaaatcatgagcggtttatttattacattcgaaggtcctgaaggtgcagggaaaacgactgttctgcaggagatcaaaaacatactgacagcagaaggccttcaggttatggcaactcgagagccaggcggaatagatattgcagaacaaattcgagaggttattctgaatgagaacaatatattaatggacccaaaaacagaagctctcttatatgcggctgcaagacgccagcatttagttgaaaaagtaaaacctgctttagaacagggggttatcgttctttgcgacagattcatagacagttctcttgcgtatcaaggatatgcaagagggcttggaattgatgaggttctgtccattaatgaatttgccattggagatatgatgccccatgtaacggtttatttttcaattgatccggaagaaggactgaagcgtatttacgcaaacggctcacgggagaaaaacaggctcgatttagaaaaactggactttcatacaaaagtacaagaaggttatcaagagctgatgaagcgatttccggaaagatttcattcagttgatgccgggcaatccaaagacctcgtcgttcaggatgttctaaaggtgatcgatgaagcgttgaaaaaaattcaattgtgacctgtttcccaatagttgatataataatgtaaacgagatcacgttgtttccaatctaaaggaggccttcacagatgaaattgatagtggcagttgtacaagatcaggacagcaacagacttttgaaaaccttaacggatcacaacttcagagtcacaaagcttgcgacgacaggaggatttcttaaatcaggcaatacaacgtttatgatcggtgtcgaggatatacgcgtcaataaagcgttgagtctcattaaagaaaacgggcagaaacgtgatcagatgattgcccctgtatctccaatgggtggaaatgctgattcctatgtcccttatccagtcgaagttgaagttggcggagcgacagtatttgtccttccagtcgatgaatttcatcaattttaaggatctgaaactgtgaaaattaataaagatatacgtacatttatagataataagcagattccctctgtgaaaacatctgagatcacggcatcgtttaaaacatcaatggaaaaccaaagcagcaaaatgaagcttgatcagcttaccaggttgttatctgatatagaagcattcggaaaaaggctaacgaaatctcggaattttaaagacttagcgagatttaaaggacttgtgaaacgttttgtcaaggaagctgtggacagcggcctttcacatgaaacatcgaaaagctttgacctttacgggaacagcagaacgctgggacttgtgaaagaaatagatgacaaattgatacagcttacggaagagatgatggatcaggaaaaaccggcaattgatttgctggagcgtattggcgaaataaaaggtttattaattaacctttacacatagagagtgatacaatggcaatatcctggaaggaaatgaacgagcttcagcccagagtgatgaagcttttatataatagtattgagaaggacagactatcacacgcttatttgtttgagggaaaaaaaggaacaggcaagcttgatgccgcgctgcttcttgcaaaaagcttcttttgtctggaggatggcgcggagccttgtgagagctgccgaaactgtaaacggatagagtcagggaaccatcctgatctccatcttgttcagcctgatggcttatcaatcaaaaaggcgcaaattcaagcgctccaagaagagttttctaagacaggacttgaatcgcataaaaagctgtatattatttcgcacgcagatcaaatgacagcaaatgcggcgaacagcctgctgaaatttttagaagaacctaacaaagacacaatggccgtcctcatcactgagcagccccaaaggttattggataccatcatttcaagatgccaaacccttccttttcagcctttgcagccgaaagcaattgaagatagactgatcgaacaggacgtctcgcctcatatggcaaggcttctagccaacatgaccaataatgtagcagaagcagtcgaattaagtcgaaatgatgagtttgcagagtctagagcgaaagtgataaaattgtatgaagtcctacaccagcggaaaggacatgcttttttctttattcaagatcaatggatgccctttttcaaagaaaaaacccatcaagaaatgggtcttgatatgctcttattgatatatcgtgatgtgttgtccatccaaataggaaatgaagataaattgatttatcaagacttattccaatcaataaaacagcatgcgctacaatcaacacaacaaagcgttacgaatcagatacttgctgttttagaagcaaagaaacggcttcattccaatgtgaatgtacaaggattaatggagcacttggtgttaatgttgcaggagggataagcttgtacaatgtaattggtgtccgctttaagaaagcgggtaaaatatattattttgatccgaatggatttcatatagaacatgacagctgcgtaattgtagaaactgtcagaggcgttgagtacggccaggtcgtaattgcaaataaacaggtggatgagcatgatgtggtgcttccccttcgaaaagtgatacgtgtggctgacgagcgcgatcttctcattgtagaagaaaataaacaggaagcactatcagcatttgatatctgccaaaagaaagtgattgagcatggcttggatatgaagctggtcgatgttgaattcacgtttgatcgcaataaagtcattttttacttcactgctgacggccgagtcgactttagagagcttgtaaaggatttggcttctatctttaagacaagaattgagctgcgccaaatcggagtgagggatgaggcaaaaatgctcgggggaatcggtccttgcggaagaatgctttgctgttcaacgtttcttggagattttgaacctgtttccattaaaatggccaaggatcagaacttgtctttaaatcctacgaagatttcgggtctttgcggacgattgatgtgctgtctaaaatatgagaacgatgagtatgagacggcaaaagaacagcttccggatataggagaaatgattacgacagcaaacggtcccgcgaaggtcgtcggactaaatattctggaacgggtgcttcaggtggaactgataaaccgtgaaaaagtgatagaatatacttgggaagagctcttggaagagggcgtcgtatccgcacaaaccacagattaacgaggtgtggaaccttggataaaaaagagttatttgatacagtcattaacttagaagaacaaattggctcactgtacaggcagctgggggatttgaagcagcatatcggtgagatgattgaggaaaatcatcatttacagcttgaaaacaagcatttgcgcaaacggctggacgatacgacgcagcagattgaaaagttcaaagctgataaaaaagaatcaaaaacacagaagacagagcaaactgatataggggaaggatatgataatctggcacgtctgtatcaagaaggatttcatatctgcaatgtccactatggtagtgttcgaaaagaagattgtcttttctgtctgtcattcttaaataaaaaatagggaaaaggcttccgcataagacgggagcctttttcaaaggtactgaaaggataagaagatggtttcattacatgatgatgaaagattagattatttgctggcagaggacatgaaaatcatacaaagcccaacagtgtttgctttttcgttggacgctgtgcttctgtccaaatttgcgtacgttccgattcaaaaagggaaaatcgttgatttatgcaccggcaatggtattgtgccgctgctgctcagtacaagatcaaaagcagacattctgggagtcgaaatacaagaaaggctgcatgatatggctgttcgcagcgtggagtataataagttggacgatcagattcagatcatacatgatgacctgaaaaacatgccggagaaacttggacataatcgatatgatgttgtcacctgcaatccgccgtattttaaaacaccgaaacaaactgaacaaaacatgaatgagcatctccgaatcgcaagacatgaaatccactgcacactggaggatgtcatttcagtcagcagcaagctgctcaagcaagggggaaaagcagctcttgttcaccggccgggaaggcttctggagatttttgaactgatgaaggcttatcaaatcgagccaaaacgtgtacaatttgtctatccgaagcaagggaaagaagccaataccattttggttgaaggtatcaaaggcgggcgcccggatttaaaaattcttcctcccttattcgtttatgatgaacaaaatgaatatacaaaagaaatcaggaccattttatatggagacaaataaccatttcttctacgtcgtgaaatgtaaggacaatagctggtatgccggatataccaacgatctgcataaacgagtgaaaacgcacaatgatggaaagggcgcaaagtacacaaaagtaagacgtccggttgaattaatttttgccgagagcttttcaacaaagcgggaagctatgcaggcggaatattatttcaaaaaactaactcggaagaaaaaagagctttatatagaagaaaagcggaacagcaaggaggctgtatatgttaaggcgccaaatgagctttaatggaaagtcggacatggggattctttacttggtcccaaccccaatcggaaatctagaggatatgacattccgggcgatcgacacgctgaaatcggtggatgcgattgctgcggaagatacgaggcaaacgaaaaagctttgtcatgtatatgaaattgaaacaccgctcgtcagctatcacgaacacaataaagaaagcagtgggcacaaaattattgaatggctgaagtcgggaaaaaacattgctcttgtcagtgatgccggtctgccgacgatttctgatcccggagcggaaattgtaaaggattttacggatataggcggttatgttgttccgttgccgggagcaaatgccgcattaacagctcttattgcttcaggtattgtaccgcagccttttttcttttacggttttctcaacagacagaaaaaagaaaagaagaaggagcttgaagcccttaaaaaacggcgggaaacgatcattttttatgaagcgcctcacagattgaaggaaaccttgtcagcgatggcagagatattaggagatcgggaaattgctgtaacgcgtgaactcactaagaaatatgaagagtttatccgaggaaccatatctgaggtcattggatgggcaaacgaagatcagatacgcggcgagttttgtcttgtcgtagaaggaagtaataatgaagaggtagatgaggaagaacaatggtgggaaaccctcactgcgaaagaacatgtcgagcattacatctcgaaaggcgctacgtctaaagaagccattaaaaaagcagcagtcgatcgcaatgtaccaaagcgtgaagtgtacgatgcttaccatattaagcaataaaaaaacgttcttgtgtcataacaagaacgttttttgtacaagaaatgattatttaaggttttgaagctggttttggatttcgctgatgatttgctcagcgccttctttactaagaaccaatttaccgcctgcaagtttaaggttatcatcagaaacttcaccagttacttggcaagtcatgtttggtttatattttttaaggatgattttttcatcatcaacatagatttcaagagcatctttttctgcgattccaagagtacgacgcagttcgataggaataactacacgtcctaattcatcaactttacgtacaataccagtagatttcataaacattctcctcccaagagatacttatttgtttaaattatatttttcttcgtcattattcgacaaaatccttaccttcatagcataacaaggtttccaataatcgtcaatcattttgtttactattgattgtaagaattagttcttatagtcagtaatgtcttagaaactaccgaaataacagcattttataaatatttaataaagctattatcctactaaaaatccttttaaatcaagactttcgaaccaaagttttttatttcatttgattatatacgacaaaattcgacacgaacagactttttttattttcattaaagatttttaattttaattattctttttcagggcgtatgtatatattcttgatcttaaaggctaagatggtatcatagataaaggataaatataaataatattcatatatgatttgcacttatcgccgctctcgtcctttgggcgggagctttttgacattctgattaggaggtttcaagatgccgcaagaaaacaatacattttacattacaacaccgatttattatccgagcggaaaattacatatcggccatgcatatacgacagtcgcgggagatgcaatggcacgttacaaaagattaaaagggttcgatgttcgctatttaacgggaacggacgagcatggacaaaagatccagcaaaaagctgaacaggaaaacattacacctcaggagtatgtggatcgcgcagcggcagatattcaaaaactgtggaagcagcttgaaatctcaaacgacgactttatccgcacgacagaaaaacggcataaagttgtcattgaaaaggtgtttcaaaagcttcttgataacggggacatctatcttgatgagtatgaaggctggtacagcatccctgatgaaacgttctacacggaaactcagctcgttgatattgagcggaatgaaaagggagaggtcatcggcgggaaaagccctgacagcggtcacccagttgaattgatcaaagaggaatcttatttcttccgcatggggaaatacgcggatcgtcttctgaaatactatgaagaaaacccgacattcattcagccagaatcacgcaaaaacgaaatgattaataactttatcaaacctggacttgaggatttggcagtatcacgtaccacttttgattggggcgtgaaggtgccggaaaatccaaagcatgttgtatatgtttggattgacgcactatttaactatttaacggcactcggttatgatacagaaaatgatgagctttatcaaaaatattggcctgccgatgttcatttagtcggtaaggagattgtacgattccatactatttactggccaattatgctgatggcgctggatcttccgctgccaaagcaagtattcgcgcatggctggcttttgatgaaagacggaaaaatgtcgaaatcaaaaggaaacgttgtagatccggttacattaattgagcgctatggtttagacgagcttcgctattacctgcttcgcgaagtgccgttcggatctgacggagtattcacgccggaaggatttgttgagcggattaactatgatttagcaaatgatttaggaaatctattgaatcgtactgttgcgatgattaataagtattttgacggacaaatcggttcttacaaaggtgctgttacggaatttgaccatacgctaacttctgttgctgaagaaacagtaaaagcttatgagaaagcaatggaaaatatggagttctcggtagcactttcgactttatggcagctcatcagccgcacaaacaaatacattgatgagacagctccatgggtgcttgcgaaagatccggcaaaagaagaagaattgcgatcagttatgtatcatctcgctgaatcattgcgtatttcagcggtactgcttcagccattcttaacaaaaacacctgaaaaaatgttcgagcagctgggcattactgatgaatctttaaaagcttgggacagcattacagctttcggccagctgaaagatacaaaagtacaaaaaggcgagccattgttccctcgtttagaggcagaagaagaaattgcttacatcaaagggaaaatgcaaggttcagcaccagcgaaagaagaaacaaaagaagaagagcctcaagaggtcgatcgtttacctgaaattacgattgatcaattcatggatgtagagcttcgcgtagctgaggtcattgaggcagaaccagtgaaaaaagcagaccgtttattgaagctgcagcttgatcttggttttgaaaagcgccaagtggtatccggcattgcgaagcattatacgcctgaagagcttgttggaaaaaaactcgtttgtgtaacaaatctaaaaccggttaaactcagaggagagctttctcaaggtatgatccttgcaggagaagcagacggcgttttaaaggtcgtgtctatcgatcagtcgttaccaaaaggcacaagaattaaataatgataaaacaaaaggtgtttcacgtgtaacaattcgtcgaacaccttttgtgtttcgacaagaaaggagtttttcacttatgttgtttgacacacacgcgcatttaaatgcagaacaatatgatactgatcttgaagaggttattgaacgggcaaaagctgaaaaagttgaacgaattgtcgtagttggttttgaccgtccgacgattacccgtgcgatggaaatgattgaggaatatgattttatttatgcagccattggctggcaccctgttgacgctattgacatgacagaggaagacttagcgtggattaaagagctttctgctcatgagaaagtggtagcgataggggaaatgggactggattatcattgggataaatcacctaaagatattcaaaaagaggtgtttagaaaacaaatcgccttagcgaaagaggtcaatttgcctattatcattcataaccgtgatgcaacggaggatgtcgtgaccattttgaaagaggaaggcgcagaagctgtgggcggaatcatgcactgctttacaggaagtgcggaagtggcaagagaatgcatgaaaatgaatttttatttatcatttgggggaccggtgacatttaaaaatgcgaagaaaccgaaggaagtagtgaaggaaattcccaatgaccggctgctgattgaaacggactgcccgtttctcacaccgcaccctttccgcgggaaaagaaatgagccaagctatgtgaaatatgtggcagaacaaatcgccgaattaaaagaaatgacctttgaagagattgcttccatcacgactgaaaatgcgaaaagacttttccgtataaactgacaaaaaacgctagcgggttttgtaagagcttgtcccttacagcgtttttctataaaagttctacatgctttcttctcctcataggataggtttgtcgacaagtctttcttccgtttctcagtgtatttcaggataatgaagaggacactgagcttttgggagaaagagaagggagggttgacagccttttagatactctatataatctctccgaggagaaggaggcgtttttcatcacacaaaaaatgaaaaagctgttttccgtaaagcttagcaaaagcaaagtcattctggttgctgcttgtttgcttttggcaggaagcgggactgcgtacgcggctcatgagctgacgaaacaatcagtctcagtttctatcaatggcaaaaagaaacatatacgcacacatgcaaatacagtcggtgatcttttggagacgcttgatataaagacaagagacgaagacaagatcacacctgctaaacagacaaagataacagcagacatggacgttgtgtatgaggctgcaaaacctgtgaagcttacaataaacggggaagaaaagacgttatggtcaacagcaaaaacggtcggtgcattactggacgaacaagatgttgatgtgaaagaacaagatcaaattgatcccgtaatagatacagatatttcgaaagacatgaagattaacatagagcccgcatttcaggttactgtgaatgatgcagggaaacaaaagaagatctggacgacttcgactacggtcgctgactttttaaaacagcaaaagatgaacataaaagacgaagataaaatcaagcctgcgttagatgcaaagctgacgaaaggaaaggctgatattacaattactcgtatcgaaaaggtcaccgatgtagttgaagagaagattgcgttcgatgtgaaaaagcaagaagacgcttctcttgaaaaagggaaagaaaaggtcgtccaaaaaggaaaagaaggcaagctaaaaaaacatttcgaagtcgttaaagaaaatggcaaagaagtgtccagagagcttgtaaaagaagaaacagctgagcaaagcaaagataaagtgattgctgtcggcacaaagcaaagcagtccaaaagttgaaacggtcagtgcttcaggtgattcaaaaacagttgtgtcccgcagcaatgaatcaacaggcaaagtcatgactgtatcatctacggcttatacggcaagctgcagcggttgttcaggacatacagcgacaggcgtcaatttaaaaaataatccgaatgccaaagtcatcgctgtggatccaaatgtcattccgctaggctccaaagtccacgtggaaggctatggatatgccattgctgcagataccggttcagcgattaaagggaacaaaatagacgtctttttcccagagaaatcatcggcgtaccgatggggaaataaaacagtcaaaattaaaatcttaaattaatatatacttatgtattcagagggttttgcgccctctgtttttttcgttataatagacaaagtgcattttctgcttattagacgctcgatataagaaaaagtttcatgaatatacaaaagtttttattttgtcttggaggaaataatgaaaattaaagagatcattgtggtcgaggggcgtgacgatacggcccgcatcaaattggctgttgatgcagacacaattgaaacaaatggttcagccatcgatgatcatgtgattgaccaaatccgtttggcccagaagaccagaggcgtcattattttaacggatccggactttccgggagagaagattcgcaaaaccatctcagaggctgtacctggctgtaagcatgcatttttgccaaaacatcttgccaaacctaaaaacaagcggggaattggtgtagagcatgcatcggttgaaagcattagggcatgtttagaaaatgtgcatgaggagatggaagcgcagccgagtgacatttcagctgaggatttgattcatgccggactaataggcgggcctgcggccaaacgccgccgggaacgactgggtgatctgttgaaaatcggctatacaaatggcaaacagcttcaaaaacggctgcaaatgtttcaaattaaaaaaagtgattttatgagtgcgctcgataccgttatgcgggaggaacagaatgaataaagatattgcgacaccgattagaacgaaagagatactgaagaaatacggtttttcttttaaaaagagcttaggacagaatttcttaattgatacgaacattttaaacagaattgtcgatcacgcggaagtgacggagaaaacaggtgtcattgaaatcggcccgggaatcggggctttaaccgaacagcttgccaagcgggcgaaaaaggtcgtggcatttgagattgaccagcgactattgccgattctgaaggatacactgtcaccttacgacaatgtcactgtcattcatcaggacgtgttaaaggctgatgtcaaatcagtcattgaagaacaatttcaagattgtgatgagatcatggtagttgccaaccttccttattacgtaacaacaccgattatcatgaaactgcttgaagaacaccttccgctgaaagggattgtggtcatgctgcaaaaagaagtggctgagcgcatggcggctgatccttcatctaaggaatacggctcgctttcaatcgcggtgcagttttatacagaagccaaaacggtgatgatcgttccgaaaaccgtatttgttcctcagcctaatgtcgattccgcagtcatccgtctgattctccgagacggcccggcagtggacgtggaaaacgaatcctttttctttcagctcatcaaggcaagctttgcacagcgtcgtaaaacgctgctcaataacttagttaacaatctgcctgaaggaaaagcgcaaaaatcaacgattgagcaagtgctcgaagaaacaaatattgacggtaagcgccgaggcgaatccctgtctattgaggagttcgcagcgctgtctaacggattgtataaagcccttttctaaaagggctttttgttttgcgcaccacatggactgccgctacataggctagagaaggacctttcattcaatgataagaaaaaacttggactcagcgaaaaaaggcgctttctcaaggctctttctttcatgatgaggcttagtctatgtgtggagtgaggaatgtgcaatttcaaataggggatatggtagccagaaaatcctatcagatggatgttttgtttcgaattataggaatagagcaaacaagcaaaggaaattcaattgccattttgcatggagatgaagtcaggctgattgctgattcggatttttctgatctggtagcagtgaaaaaagatgagcagatgatgcggaaaaagaaagatgagagcagaatgaatgagtcgctcgaattgctccgccaagattataagctgctcagagaaaagcaggagtactatgcgacaagccaatatcagcatcaggagcattatttccatatgccgggcaaagtgcttcatctggatggcgatgaagcatatctgaaaaaatgcctgaatgtctataaaaaaattggagtgccggtctatggcatccattgccatgaaaagaaaatgtctgcttctattgaagaattgctcgacaaatatcgacctgatatcctggtgatcacagggcatgatgcgtattcgaagcaaaagggcggcattgatgatttgaatgcgtacagacattctaagcactttgttgaaactgttcaaacagcccgaaaaaagatccctcacttagatcagcttgttatttttgcgggggcctgccaatcccattttgaatcactcatcagagcgggtgcgaattttgcgagttcaccgtcaagagtcaatattcatgcgcttgatccggtatatatcgtcgcgaagatcagctttacgccgtttatggaacggattaatgtatgggaagtgctccgtaatacgctgacaagagagaaagggcttggaggtattgaaacaagaggagttctgagaattggtatgccttataagtccaattaacagttgaaaacctgcataggagagctatgcgggttttttattttacataatgatacataatttaccgaaacttgcggaacataattgaggaatcatagaattttgtcaaaataattttattgacaacgtcttattaacgttgatataatttaaattttatttgacaaaaatgggctcgtgttgtacaataaatgtagtgaggtggatgcaatggcgaagacgttgtccgatattaaaagatcgcttgatgggaatttaggtaaaaggctgacgttaaaagcaaacggtggccgccgaaaaacgattgagcgttcgggcattttagctgagacgtacccttctgtttttgtgatacaactagatcaagacgagaactcgtttgaaagagtttcatacagttatgctgatattttgactgagactgttgagctgacatttaatgatgacgccgcaagctcagtggcattttaacgggcagtgaaccttttgtttactgctttttgttttgcccttttttggtttccaataattttaacgaaagttccatctgatttaacaaaagataaaacagtcacatattatcgtgacgtgcacgaatggctatcacttctaaaaaaggggttgtttcgtttgggcagacgtcgtggagttatgtcagatgagtttaaatatgagctggctaaagaccttggtttttatgacacagtaaaaaatggcggctggggcgaaattcgggctcgcgatgccggtaacatggtaaagcgcgctattgaaatcgccgaacagcaaatggctcagaatcagaataaccgataaggatgtgacccgggggacgtgctgttccctggtttttttattttggatataaatacataatgggctgaatatggatatgttcatcctgtacttcaaatgtgatacaatgttcatacttatgtttagatggagaagtaggtgaaagctatgcgtattttagaaaaagcgccagctaagatcaatctgtcacttgacgtcacccgaaaacgcccggatggctatcatgaagtcgaaatgatcatgacgacaattgatttagctgatcgaattgaattgacggagcttgcagaggatgaagtgagggtttcctcccacaaccgatttgtgcctgatgaccaaagaaacttagcttatcaggctgccaagctgatcaaggacagatacaacgtgaaaaagggagtttccatcatgattacgaaggtaattccggtggctgccggtcttgccggcggaagcagtgatgcggcggcgacactcagagggctgaacagactgtggaatttaaatctgtccgcggaaacgcttgctgagcttggagcggaaattggctctgacgtttcattttgtgtctatggcggaactgcattagcaacagggcgcggcgagaaaattaaacatatcagcacgcctccgcactgctgggtcattttagcgaagccgacaatcggtgtttcaactgctgaagtgtacagagcgctgaaactggatggtatagagcatcccgatgtacaaggcatgatcgaggcgatagaagagaagagttttcagaagatgtgcagccgtttaggcaatgtgcttgaatctgttacactcgatatgcatcctgaagttgcaatgatcaaaaaccagatgaaacgctttggtgcagatgccgtgttaatgagcgggagcggcccgacagtgtttggactggttcagtatgagtcgaaggtgcagagaatttataacgggttaagaggcttctgcgatcaagtttatgcggtgagaatgatcggcgaacagaacgctcttgattaaatccgtatgttaagttatattgatcttaaaatattcggattttgggggtaagttcatgaagtttcgtcgcagcggcagattggtggacttaacaaattatttgttaacccatccgcacgagttaataccgctaacctttttctctgagcggtatgaatctgcaaaatcatcgatcagtgaagatttaacaattattaaacaaacctttgaacagcaggggattggtactttgcttactgttcccggggctgccggaggcgttaaatatattccgaaaatgaagcaggctgaagctgaagagtttgtgcagacacttggacagtcgctggcaaatcctgagcgtatccttccgggcggttatgtatatttaacggatatcttaggaaagccatctgtactctccaaggtagggaagctgtttgcttccgtgtttgcagagcgcgaaattgatgttgtcatgaccgttgccacgaaaggcatccctcttgcgtatgcagctgcaagctatttgaatgtgcctgttgtgatcgttcgtaaagacaataaggtaacagagggctccacagtcagcattaattacgtttcaggctcctcaaaccgtattcaaacaatgtcacttgcgaaaagaagcatgaaaacgggttcaaacgtactcattattgatgactttatgaaagcaggcggcacaattaatggtatgattaacctgttggatgagtttaacgcaaatgtggcgggaatcggcgtcttagttgaagccgaaggagtagatgaacgtcttgttgacgaatatatgtcacttcttactctttcaaccatcaacatgaaagagaagtccattgaaattcagaatggcaattttctgcgtttttttaaagacaatcttttaaagaatggagagacagaatcatgacaaaagcagtccacacaaaacatgccccagcggcaatcgggccttattcacaagggattatcgtcaacaatatgttttacagctcaggccaaatccctttgactccttcaggcgaaatggtgaacggcgatattaaggagcagactcatcaagtattcagcaatttaaaggcggttctggaagaagcgggtgcttcttttgaaacagttgtaaaagcaactgtatttatcgcggatatggaacagtttgcggaagtaaacgaagtgtacggacaatactttgacactcacaaaccggcgagatcttgtgttgaagtcgcgagactcccgaaggatgcgttagtcgagatcgaagttattgcactggtgaaataataagaaaagtgattctgggagagcccgggatcacttttttatttaccttatgcccgaaatgaaagctttatgacctaattgtgtaactatatcctattttttcaaaaaatattttaaaaacgagcaggatttcagaaaaaatcgtggaattgatacactaatgcttttatatagggaaaaggtggtgaactactgtggaagttactgacgtaagattacgccgcgtgaataccgatggtcgcatgagagcgattgcatccatcacgctggatcacgaatttgttgtacatgatattcgtgtgattgatggaaacaatggtcttttcgttgcgatgccgagtaaacgcacccctgatggagagttccgcgatattgctcatcctattaattcaagcacgcgaggaaagattcaagatgccgtgttaaatgagtatcatcgtctgggtgacactgaagcattagaattcgaagaagctggagcttcttaaaaaataaccaaaaagcaaggactgctgaaagggctgacataagccttttgccggcggtccttttttaattctgatttttcaaacttagttgcactcaatagaaaattcttgcacttcatgaagtctccttgaaatcagaagatatttaggatatatttttctatggataaaagggatattggaggccaataaatggataagcggtttgcagttgttttagcggctggacaaggaacgagaatgaaatcgaagctttataaagtccttcatccagtttgcggtaagcctatggtagagcacgtcgtggacgaagccttaaaattatctttatcgaagcttgtcacgattgtcggacatggtgcggaagaagtgaaaaagcagcttggtgataaaagcgagtacgcgcttcaagcagaacagcttggcactgctcatgctgtaaaacaggcacagccatttcttgctgacgaaaaaggcgtcacaattgtcatttgcggagatacgccgcttttgacagcagagacgatggaacagatgctgaaagaacatacacaaagagaagcgaaagctacgattttaactgcggttgcagaagatccaaccggatacggccgcattattcgcagcgaaaacggagcggttcaaaaaatcgttgagcataaggacgcctctgaagaagaacgtcttgtaactgagatcaacaccggtacgtattgttttgacaatgaagcactatttcgggctattgatcaggtgtctaatgataatgcccaaggcgagtattatttgccggatgtcatagagattcttaaaaatgaaggcgaaactgttgccgcttaccagactggtaatttccaagaaacgctcggagttaatgatagagttgctctctctcaggcagaacaatttatgaaagagcgcattaataaacggcatatgcaaaatggcgtgacgttgatcgacccgatgaatacgtatatttctcctgacgctgttatcggaagcgatactgtgatttaccctggaactgtgattaaaggtgaggtgcaaatcggagaagatacgattattggccctcatacggagattatgaatagtgccattggcagccgtacggttattaaacaatcggtagtcaatcacagtaaagtggggaatgatgtaaatataggaccttttgctcacatcagacctgattctgtcatcgggaatgaagtgaagatcgggaattttgtagaaattaaaaagactcaattcggagaccgaagcaaggcatctcatctaagctatgtcggcgatgctgaggtaggcactgatgtaaacctgggctgcggttcaattactgtcaattatgatggaaagaataagtatttgacaaaaattgaagatggcgcgtttatcggctgcaattccaacttggttgcccctgtcacagtcggagaaggcgcttatgtggcggcaggttcaactgttacggaagatgtacctggaaaagcacttgctattgccagagcgagacaagtaaataaagacgattatgtgaaaaatattcataaaaaataatcctaaattcggaggtttatccatgtctaatcaatacggagataagaatttaaagattttttctttgaattcgaatccagagcttgcaaaagaaatcgcagatatagttggagttcaattagggaaatgttctgtcacaagatttagtgacggggaagtccaaattaatatcgaagaaagtattcgcggatgtgattgttacatcatccagtctacaagtgaccccgttaacgagcatattatggaactgctgattatggtagatgcgttaaaacgcgcttctgcaaaaacgattaacattgttattccttattacggttatgcgcgtcaagacagaaaagcaagatcccgtgagccaatcacagctaaacttttcgctaacctgcttgaaacagccggtgcgactcgtgtgattgcacttgacctgcatgcgccgcaaattcaaggattctttgatataccgattgaccacttaatgggtgttccgattttaggagaatattttgaaggcaaaaatcttgaagatatcgtcattgtttcacctgaccatggcggtgtgacacgtgcccgcaaactggctgaccgactaaaagcgccaattgcgattattgataaacgccgtccgcgtccaaacgtggcggaagtcatgaatattgtaggtaacatcgaagggaagactgctatcctcatcgatgacattattgatactgcaggtacgattacacttgctgctaatgcgctcgttgaaaacggagcgaaagaagtatatgcatgctgtacacaccctgtactatcaggccctgcggtagaacggattaataattcaacaattaaagagcttgttgtgacaaacagcatcaagcttcctgaagaaaagaaaattgaacgctttaagcagctttcagtcggaccgcttctggcagaagcaattattcgcgttcatgagcagcaatcagtcagctaccttttcagctaaaccgattttgaaaggtttaaacctttatcgttttgggtattgtttgtaataggacaactaaaacgacaataggatggtgctgaatatggcaactttaacggcaaaagaaagaacggactttactcgttcgtctcttcggaatatccgtacttcaggacatgttccaggtatcatatatgggaaggatacgggtaacaaacctgtgtcattagacagtgtggagctcatcaaaacgctgagggacgaaggcaaaaatgcagtcattacgcttgaggtcagcggagaaaaacactcagtcatggtaacagacctgcagacggacccgctgaaaaatgaaatcactcatgctgattttcaagtagttaatatgagtgaggacattgaagtggaagttccgattcatctgaccggagaagccattggagtgaaaaacggaggcgtactgcagcagccgttatatgcacttactgtaaaggccaagccaaaagccattccgcaaacgattgaggctgatatttcaagcctcgatgtaaatgaagtactgacgattgcagatttgcctgctggcggtgactactcctttaatcatgaatcagatgaggttgtggcttcaatccttcctccgcagcagcaggaagcagctgaggtcgatgaagaggaatctgccgatgctcagccagaaggtgaaaacgaacaataatagcttaaggcgtaaccctcccgcggttacgtcttttgtgctagaatgagaagaattatagcccgtttatgaagacgggagttatgtgactaagggaggattcgccatgcttgtgattgccggtctcggaaacccggggaagaactatgaaaacacacggcataatgtcggatttatggtgatagatcagcttgcaaaggaatggaatatagagctgaatcaaaataaatttaacggattatacggaaccggatttgtttccggcaaaaaggttctacttgttaaaccgcttacatatatgaatttatcaggagaatgtttgcggcctttaatggactactatgatgtcgataacgaagatttgacagtcatttacgacgaccttgaccttccgactggcaagatccgtttaagaacgaaaggaagcgccggagggcacaatggcatcaaatcactgatccagcatcttggaacatccgagtttgaccgtatccgcatcggaatcggccggcctgtaaacggcatgaaggtcgttgattatgtgttaggctcctttaccaaggaggaggcacctgagatcgaagaagcggttgataaatctgtgaaggcttgtgaggcttctttgagtaaaccgtttttagaagtcatgaacgaatttaacgcaaaggtataaaatgtaacaacaaagtccatactacaccaaaatgactttttcatcaggaggtcccttgtatggctttgcattattattgtcgtcattgcggagtgaaagtaggcagtctcgaatcttcaatggtatcgacagactcacttggatttcagcacttaacaaatgaggaaagaaacgatatgatttcttataaagaaaatggagatgtccatgttttgacgatatgtgaagactgccaagaggcgcttgaccgaaatccgcattaccacgaatatcacacatttattcaataaaaagctttggtgtagacactagaccaaagcgtttttctgttctcgcaggaaacagagaggaggggccatatggacaacattcaaacctttataaaagaaagcgatgactttaaatccatcatcaacggtttacacgagggcctgaaggaacagctgctcgcgggtctgtcgggttccgcgcgttctgtttttacttctgctctggctaatgaaacgaataagcctatctttctcatcacccataacttatatcaagcccagaaagtaacagatgatctgacttcacttctagaggatcggtctgtccttttgtaccccgtcaatgaactcatttcatcagaaatcgcagttgcaagccctgaattgcgggcgcagcgattagaagtcattaatagactaacgaatggagaagcgccaattgtcgttgctccggtagctgcaatcagaagaatgctgccgcctgttgaggtgtggaaaagcagccagatgctcattcaagtaggccatgatattgaacctgaccagcttgcctcacggctggtagaggtagggtatgagcggtctgatatggtttctgcgcccggggaattcagtattcgcgggggaatcattgacatttatccgttgacttcagagaatccggtgagaattgaactttttgacaccgaggtggattcaatccgcagctttaattcagatgatcagcggtcaattgagacccttacctcgatcaatatcggtcccgcgaaggaattaattatcagaccggaagaaaaagcgcgggcgatggagaaaatcgatagtggtcttgccgcgagcttgaaaaaattaaaggctgacaaacaaaaagaaatacttcatgcgaatatttctcacgataaagaacgcttgtctgaaggccagacagatcaggagctcgtgaagtatctctcatatttctatgaaaagcctgctagtttactagattatacacctgataatacacttctgattttggatgaagtcagtcggattcatgagatggaagaacagcttcaaaaagaagaagcggagtttataacaaatcttcttgaggaagggaagattttgcatgacattcgtttgtcattcagcttccaaaaaatagtggttgagcaaaaacggcctctgctgtactactctttatttttgcggcatgtacaccatacgagcccgcaaaatatcgtcaatgtgtcaggccggcaaatgcagagtttccatggccaaatgaacgtgcttgcgggcgaaatggagcgttttaaaaaatcaaatttcactgttgtgttcttaggagcaaacaaggaacgtacacagaaattgtcatctgttttggctgattatgatatcgaggctgccatgacagacagcaaaaaagcgcttgttcagggacaggtctatatcatggaaggcgagctccaatcgggatttgagctgccgttaatgaagcttgccgttattacggaagaagaactgttcaaaaaccgtgtaaagaagaagccgcgaaaacagaagcttaccaatgcagagcgcatcaaaagctattctgagcttcaaattggagattatgtcgttcatattaatcacgggatcggaaaatacctggggatcgaaactcttgaaatcaacggcattcataaagactatttaaatatacattatcagggcagtgacaagctttacgtccctgtagaacaaattgatcaggtccaaaaatatgttggctccgaaggaaaagagccaaagctgtataaattaggcggaagtgaatggaagcgggtcaagaaaaaagtagagacatccgttcaggatattgctgacgacttaattaagctgtatgccgaaagagaagcgagcaagggctatgcgttttctcctgaccatgagatgcagcgtgaattcgaatcggctttcccttatcaagagactgaggatcagctccgttcgattcacgaaatcaaaaaagacatggaaagagaacgtccgatggaccgcttgctgtgcggagatgtgggctacggtaaaacagaggttgccatacgtgccgcgtttaaggcgatcggtgacggaaagcaggtagctctgctcgttccgacaacaattttggcacagcagcactatgaaaccataaaagagcgcttccaggactatccgattaatatcggccttctcagcaggttcagaacgcgaaaagaagcaaacgaaacaatcaaagggctgaaaaacggaacggttgatatcgtcatcgggacgcatcggctgctatcaaaggatgtcgtgtataaagacttagggctcctcatcattgatgaagagcagcgtttcggtgtaacccataaagaaaagatcaagcaaataaaagccaatgttgatgtattaacgttaacagcaacaccgattccgcgtacgctgcatatgtctatgcttggcgtaagggacctttcagtcatcgagactccgccggaaaatcgcttccccgtacagacgtatgttgtggaatataacggcgctcttgtcagagaggcgattgaacgtgagcttgcacgcggaggccaggtctatttcttgtacaaccgggtagaggacattgagcggaaagcggatgaaatttcaatgctagtccctgacgcgaaggtagcatatgcgcatgggaaaatgacagaaaatgaattagaaaccgttatgctaagttttcttgaaggagaatcagacgttctcgtcagcacaaccattatcgaaactggcgtggacatcccgaacgtcaatacgctgatcgtatttgacgccgacaagatgggactttctcagctttaccagctgcgggggcgtgtcggccgttctaaccgtgtggcgtatgcgtacttcacgtatcgccgggataaagtgctgacagaagtggctgaaaaaaggctgcaggctattaaagaattcacagagctaggttccggttttaaaatcgcaatgcgtgacttaacgattcgcggagctgggaatcttcttggtgcccagcagcatggcttcatcgattcggtcggatttgacctctattcacaaatgctgaaggaggccattgaggagcgtaaaggagacacagcgaagacagagcagtttgaaacagaaattgatgtcgagcttgatgcgtatattccggaaacttatattcaagacggcaaacagaaaattgatatgtataaacgcttcaggtctgtggcgacaatcgaagagatgaatgagcttcaagatgaaatgatcgaccgctttggaaactatccaaaagaagtcgaatacttgtttactgttgcagaaatgaaagtctatgcgagacaggaacgtgtcgagctgattaagcaggataaagatgctgtcagattgacgatttctgaagaagcaagtgctgaaattgacgggcagaagctgtttgagcttggcaatcaatatggcagacaaatcggactgggaatggaagggaaaaaactcaaaatctccatacagacgaaaggccgtagtgctgatgaatggctcgacaccgtgctgggcatgctgaagggcttaaaagatgtgaaaaagcaaaccatttcatcaacgtaaattttgttactctctggtgtatattacatttgatgtgacggatactaatttcaagcgaggcggaaggtacataaagtaactgctttaggtctttcccacatgtatataccatcaaatgaaagagaggcaccagagatgaaagcaaccggtatcgtacgtcgtattgatgacttaggtcgggtcgtgattcctaaagaaattcgaagaactctgagaatcagggaaggcgatccgcttgagatttttgtagatcgtgacggagaagtgattttgaaaaagtactctccgatcagtgagcttggagactttgcaaaggagtatgcagacgcgctttacgacagcctcggccattcagtgctgatttgtgatcgtgatgtgtatattgccgtgtccggcagctccaaaaaagattacttaaacaagtcaatcagcgaaatgctggaaagaacaatggatcagcgcagctccgtgcttgagagtgatgcgaaatcagtacagcttgtgaatggaattgatgaggacatgaattcttatactgtcggcccaattgtggcgaacggtgatccgataggtgctgtggtgatcttttcaaaagatcagacaatgggcgaagtagagcataaagccgttgaaacagcagctggatttttggctcgtcaaatggaacagtaggtcttattcctttcttcgaaaataggtatgtaaagaacagctctccttgggacgctgttctttttcatgcgtgccgaaaaaggaatccaagggttgggatgtggtataataacctcgtttttatttgtgccgcggtaatacgtgaaccgtattgcccctgacgttgggaaggagcttttggatggacgattcaataggcgttaaacggcattggatttggcagggggcttttgttttaattctggcaggcatcatcacaaaaattttaagcgctgtttacagagtcccgtttcaaaacattgtcggcgatgttggattttatatatatcagcaggtatatccctttcttggtattgcggtcatgctgtccacatcaggatttccagtcattatttcaaagctgatgaatgattatagtgaaaaaaatcatcacaccatattaaaaatatcagcgttgtttttgtctttaatcggtattttattatttctttgtttatatctgggtgctgttcctattgcactctttatgggagattcgcatctagccgtgttaattcaagtggccgcatacgcgtttctgctgttcccatttgtcgcgttgcttagaggcggttttcaggggcggcacgaaatgctcccttcagccttatcacagatgacagagcagtttctgcgtgttgcggtgctcttgggtttatcattttggctcgtgaaaaagggagcctcgctttatactgcgggagcggcagccgcttcaggctctcttgccggaagtttggttgcattgataatactgggttttttttggttcaaaacgaaaagagacaaccaaacggataggcaaaacgaaaatgtcatcacaacaaaagaattgacgaaaaaactgcttttatattcggttacaatttgtgtaagcagtttgctgcttttgtttatccagctcgttgatgctttgaatttatatgcattgctttcgggtggtgaggcaagcgaagaagcaaaacgcttaaaggggatctatgatcggggacaacccttgctgcagctcggctcagtttttgccgtaagcattgcgacgtcactcgttccgtatatttctatggctgtaaaaaacaaagagctgaagatcatgaaagaaaaaatcacgtcatctttgaaactatgccttgtgctcggtacaggcgcatcggctgggttgatttgcattcttaagccggttaatatcatgctgtttcaaaatggagaagggacaggtgcgttacaagtatttagctgctccattttgtttgcatccttggcggtaacggcagcggcagtcttacagggagcggggtacacagtttttcctgcgatagcggtgggcgcgggtgttgcagtgaaatgggtgttaaacacacttttggttccgcgctatgggattgaaggcgcatcgcttgcgacagctgcttcctttgcggctgtcgccggccttaacttgtatcagcttcggcaaaaggaatggctcgataagcttagaggcgttttgattccgattattggatctgctcttttgatgtcagctgttttgcttgcgtatacgcgtctctggactttcttgtttcctgcaacaggaagaggagcggctgtgattgagagtctttctgctgttgccattggtggcgcggtgtttatttattgtatgatgagattgggaatatttacagatgaagagctgaacagtgtgccattcggcagcaagttaagcaaattcatgagaaggagagaacaaaatggcgggtaaaattacagtcgtcggacttggtgccggagacatggaccaattgacaattggtatacacaagctgctgacgaaggcagatacgctgtatgtcagaaccaaggatcatcctttaattgaggagcttgaaaaagaaacgaagaacatccgtttctttgatgatatatatgagaaacatgatcagttcgaggcggtatatgaagaaattgcagatatcctctttgaagcggcgcggcgtgaggacgtggtttacgctgtgccgggacacccttttgtcgcagaaaaaacagttcagctgctgacggagcggcaggaaaaggaaaacgttcaagtgaaagtcgcggggggacaaagtttccttgatgccacattcaatgccttgcaaattgacccgattgaaggttttcaatttgtggatgccggcacattgtccgcggatgagcttgagctcagacatcatctgatcatatgtcaggtttacgaccaaatgacggcttctgaagtcaagctgacattgatggagaagctgcctgatgattatgaggtcgtcattgtgactgcagcaggcagccgtggcgaggagatcaggacagtgccattatttgagctggaccgcaatgtcgctttgaacaacttaacaagtgtgtatattccgccgattaaagaagagaagctgctttatcacgaattctccacgttccgaagcatcatcagagagcttcgcggacctaatggatgtccgtgggataaaaagcagacgcatcagtcattaaagcagtacatgattgaagaatgttatgagcttctcgaagctattgacgaagaagacacagaccatatgatcgaagagcttggcgacgttttgcttcaggtcttgcttcacgcgcaaattggtgaagatgaaggttatttcacaattgatgatgtcataaaaggaatcagtgaaaaaatggtccgaagacatccccatgtgtttaaagatgttaaggttcaggatgaaaacgatgttttagccaattgggaagatataaaaaaggccgaaaaaaatacatctgaatcatcattactagacagcgtaccgaaaacccttccagctctttcgaaagcagctaaattgcagaaaaaagcagcgaaggtcggttttgactgggaagacgtcagcgatatttgggaaaaggtaagtgaggaaatgaaggaattttcttctgaggtttctgaagctcctcacgaacacaatcttaaagctgagtttggcgacattttgttcgcgctggtgaatgtagcccgcttctacaaaatagagccagaggaagcgctgaccatgactaatgacaaattccggagacggttctcgtacattgaggaaacagcgaaggaagagggagtcgagttggctgatatgtcccttgaggacatggacaaactgtggaatgaagcaaaagaaactgagaggagatcatagatatgagattagataaatttttgaaagtatcacggctgatcaaacggcgtacactagcgaaggaagtagctgaccaaggacgaatctctattaacggaaaccaagctaaagctagctctgacgtaaaaccgggagatgaactaacggtccgcttcggccaaaagcttgtaacggttcaagttaatgaattgaaagacacgacgaaaaaagaagaagctgcaaacatgtacacgattctaaaagaagaaaaactcggcgaataggcttgttctaaaaaaatcccccacctcatacaatgcagtaataatgctaaaagtatcgaggatatgggggctgaatagatgaattcatattatgatcaaaaaggttcttcgtctgttccggaacagcatgatgtgacaatgaaaggccggaagcatttagatatttctggggttaagcatgtggagagttttgataacgaagaattcctgctggaaacggtgatgggaatgctctccgtcagaggccaaaacctgcagatgaaaaatcttgatgtggaaaaagggattgtttcgattaaaggcagggtatttgatttagtgtacttagacgaacaacaaggggataaagctaaagggttttttagcaagttgtttaaatgacgctgacgacacaattctatacaatgctagcgatgtccggtatgggtctctggcttggtgcttcgcttgatacataccggctctttgtcattcgtgccaaaacagccagatggctattatttattcatgatattcttttctggattgtgcaagggctgcttttcttttatgtcttgcttcatgtaaatgagggagaattcaggatttacatctttttagcggttctgctgggcgttgcgacgtatcagagcctttgcaaacgaatctatataaaaatactgaaattcgtcatttaccttgttgcttctgtttatcaattcttcaaaaaactcattcagcacgtgttatttcgtcctattgtgtggacatgcggagcgatcatctggctggcggcatttttattcaagaaaacatacagcctgataggttttctcctgctgtgtctatataaaatagtcatggttctgtgttttccgatccgttttatcgcgaaacaatgtttgaaacttcttcctgtgaaaatgcgtctaacttttagacgttattttgaaaaaggtgcaggatttctcaaaaagaagaagaaactattgataaccataagaacgaccattacacggtttttgaagaaatgaaaggaggaccgtctggtttgaatttttccagggaacgaacgataactgaaatacaaaacgactataaagaacaagtagaacggcaaaatcagctgaagaaacgaagacgcaaagggctgtacagacggttaactgtattcggcgccctagtattcctgacggcaattgtgctggcaagctctgtatggtcccaaacatcttcccttagtgcaaaagaagaaaagaaagaacagcttgaaaaagaactgaaaagtttaaagacaaaacaaacggatttaaaagaagaaatatccaaattgaaggatgaggattacgtcacagagcttgccagaagggacttattcatgtctggagacggagaaattatcttcaatgtggagaagaagagcaagtagccttgttgacacttaaatttttatttaggtataattaagcaaacgatctttttataagcctaaggaggagcactttttttatgtcgattgaagttggcagcaagttgcaagggaaaattacaggtattacaaattttggagcatttgttgaattgcctggaggctcaaccggtctcgttcacattagtgaggtagctgataattatgtcaaagacattaacgaccacttaaaagtcggcgaccaagttgaagtgaaagtcatcaacgttgaaaaagacgggaaaattggtttatctattaaaaaagctaaagaccgtccgcaagccagacctagaaatgatttccgtccgaaagaatcttttgaacagaaaatgaataagtttttaaaagacagcgaagatcgcttgtcatctttaaaacgcaatacggaatcaaaacgtggagggcgcggagcaagaagaggataacttgctgctttctataaaataaatgaagcatccgttcatcccgacggatgcttttttattatcctcatcctctttaagagtcagaaaattacaacattaaagtttctgttgacgaaagagacaaacctttgtattatataacttgtgcttagaagcacaaaacaatatggcggtgtagctcagctggctagagcgtacggttcatacccgtgaggtcgggggttcgatcccctccgccgctaccatatttgtttggcccgttggtcaagcggttaagacaccgccctttcacggcggtaacacgggttcgaatcccgtacgggtcatcctaaaaaatcggtttctcttgcagaagccgatttttttcatttttagacaacattccggaaattcttttcataaacgaatatcaaggcagaaaccgtcgaagatttctttggtattgttaccttcttttgacaaaatcctatctgtgctttcgctataatgacaggcaacgaatataacaggtgggagatgagaggaatggaaaaagcagaaagaagagtgaacgggccaatggcgggacaagctttggaaaaactccaatcgttttttaacaggggcacgaagctggtgactcatcatttgcattcactgtttttctataaaggattcatttatgttgttatcggatttttgcttggacgggctttcatattatccgaggtgcttcctttcgcacttcctttctttggagcgatgcttctcatcagaagagacaaagcgttttatgcggttttggctgtgcttgcaggtgcgctgaccatatctccaaagcactcattgctcatactggcggcattgctggcattcttcgtattttctaaagtggctgccttcattaccgacgatcgtgttaaagcactcccgattgtcgtgttcttctcgatggctgcagcaagagccgggtttgtttatgcccaaaatggcgtatttacaacctatgattatgtaatggctatcgttgaggctggactgtcgtttatcttaacactgattttccttcagagccttccgatttttactgtgaaaaaagtgaaacaatcattaaaaatagaggaaattatctgctttatgattcttattgcctctgttttaacggggctggctggcttgtcctaccaagggatgcaggcagaacatatattggctcgttatgttgtgttgagtttttcctttattggcggagcaagcatcggctgtacggttggtgttgtgaccggcctgattcttggcttggcgaatatcggaaacctatatcaaatgagtctgcttgctttttccggtttattgggcggtttgctgaaggaaggaaaaaaagcgggtgcagcaatcggtctgatcgttggttcacttcttatatctttatatggtgaaggctctgccggtctgatgacaacgctctatgagtcattaatcgcagtcggcctgtttttgctcacacctcaatctattacaaggaaagtggcgagatatattccgggaactgtcgagcatcttcaagagcaacagcaatacgctagaaaaatccgtgatgtcactgctcagaaggtagaccagttctccaatgtatttcacgcgctgtctgaaagctttgcaaccttttaccaagcgtcagacgaacagacagatgacagcgaagttgatctgttcttaagcaaaatcacggagcattcctgtcagacgtgctacaagaaaaacaggtgctgggtacagaactttgataaaacatatgatttaatgaaacaagttatgcttgaaacagaggaaaaagaatatgcatcaaaccgaaggctaaaaaaagagtttcaacagcattgttctaaatccaagcaggttgaagagctgattgaggatgagctcgcacatcatcatgcccatttgacactcaagaaaaaagtccaagacagcaggcgccttgttgctgaacagcttttaggtgtttctgaggttatggccgacttttctcgggaaataaaaagagagcgagaacagcactttctgcaggaagagcaaatcatagaagcgcttcagcatttcggaattgagattcagcatgtcgagatctatagccttgaacaaggaaatatcgatattgaaatgaccattccgttcagcggacatggagaaagtgaaaaaatcattgcccctatgctgtctgacattctggaagaacaaattcttgtgaaagctgaacagcactctccgcatccgaatggatacagccatgtcgcctttggatcaacaaaatcatacagggtgtccacgggagctgctcacgctgcgaagggcggcggccttgtctccggcgacagctacagcatgatggagcttggagccagaaaatatgctgcagcaatcagtgacggaatgggcaatggcgcaagagcgcactttgaaagcaatgaaacgatcaagcttcttgaaaaaatccttgaatcgggaattgatgaaaaaatagcaattaaaacgatcaacagcatactgtctctaaggacaactgacgaaatatattccacgcttgacctatctattatcgatcttcaagatgccagctgtaaatttttgaaggttggatcgacgcctagctttatcaaacggggtgaccaggtcatgaaagttcaagcgagcaatctgccaatcggtattattaatgaatttgatgtggaggttgtgagtgaacagctgaaagctggtgacctcttaattatgatgagtgatggcatttttgaggggcctaagcatgtggaaaatcacgacttatggatgaagcgtaaaatgaaagggttgaaaacaaatgacccgcaggagattgcagatttgcttatggaagaagtcatccgcacaagatccggccaaattgaggacgatatgactgttgttgttgtccggattgatcacaatacaccgaagtgggcatccattcctgttccggcaatctttcaaaacaaacaagaaatttcataacgcttccgtataaatcaaatttcttctggcgaagatgggaatatatgaatctgagaatcctcgtattctccaggaggaatgaatgtgaacaacggacatttaaatcaaattttgctgataacggatggctgctcaaaccatggggaagacccgcttgcaatggctgcttttgctaaagagcaggggattacggtaaatgtcattggtataatggaagaaaatcaaattgaccctgaggcaatgaaggaagtcgaagggattgcacttgccggaggaggtgtgcaccaagtcgtttatgcatctcagctttcacaaactgttcaaatggtaacaaagaaagcgatgacgcaaaccttacaaggtgtagtcaatcaagaactgaaacagattctcggaaagaatgtggaaatggaagagctttctccggaaaaacgcggcgaagtcatggaagtggtagacgagcttggagaaacggtgcatcttcaggttttggttcttgttgatacaagtgcaagtatggcgccaaagcttccaacagtaaaagaggcgctgattgatttgtctgtaagcctcaattcccgaatcgggaataacgaatttgcgatgtgtatatttcccgggaaaaaacaagaggtcgagcttgtgctgaactggacaccgaagctgcaatctctttccacactctttgcaaagctttcgacaggcggcatcacgccgacaggtccggcgattcgtgaagcgacactgcagtttgaaaaaatacgctcaagaaggggcatgctggcagatgatgaacgacgctttgacgagtttggcatgtagcctcaagccgggtacgacaatcaaaggcaagtggaatggaaacacttatacattgcgtaaacagcttggtaaaggggccaatggaattgtgtatttggcagaagcatcagatggacatgttgccttaaaggtgagtgatgacagcctgtctattacttctgaagtgaatgtcttgaaatctttctcaaaggcccagtccgttacgatggggccttctttttttgatacggatgatgcctatattcccagtaccaatacgaaagtttcattttatgcaatggaatacataaaagggccgctgcttttgaagtatgtcagtgataaaggagcagagtggatacctgtattaatgattcagctgttatccagcttatcggtgcttcaccagcaaggatggatattcggcgatcttaaacctgataatctgatcgtaactggtccgcccgcaaggatccgctgcattgatgtgggcggcacgacaaaggaaggccgggcgataaaagagtatacggagttttatgacagaggctattgggggtatggaacaagaaaggcagagccatcctatgatctgttcgcagttgccatgattatgatcaacagtgtgcataaaaaagaatttaagaaaacgaaccagcccaaagaacagcttaggtctctcatcgaaggaaaccctctgcttcaaaagtataaaaaagtgcttttttcaaccttgaacggagattatcaatccgcagatgaaatgaaaaaggatatgctagacgcggggcaaaaagcagcacaaagaaaacagcctataaaagcatcaccgcagcctgccacacgacatagacagcaaaaaccgcgccaaggaaaaataacgaagacgcgatataccccaaaacagaaaccggctaagtcgggggggttatttgaaacaacgctgatcgtgatcagtgttttagcgctttatttcgcctatattatctttttcttaatctgaatggtgcaaactgcagagcctatgcttcttctttgcttggaggggttgaaagtgttaggatatgaatatctttaaaatacctgctcattgtgaggaggacattgtgaaaagtgtcaaagattttttaaacaaacacaatcttacgttaaaaggggcgacgatcattgtaggcgtttctggcggtccggactcaatggctcttcttcacgcgttgcatacgttatgcggccgttcagcgaatgttattgcagctcacgttgaccatcggttcagaggtgcggaatccgaggaggacatgcgttttgtccaagcttattgtaaagctgaacagctcgtgtgcgaaacggctcaaatcaatgtaaccgcatatgcacaggaaaaaggactcaataagcaggctgcagcacgcgattgccgctaccagttttttgaggaaatcatgtcgaagcaccaagcggactatctggctcttgcgcatcatggtgatgaccaggttgaaacaatgcttatgaaactggctaagggtacgcttggaacgggacttgcgggaatgcagccggttagacgttttgggacggggcggatcatcaggccgttcttaaccattacaaaggaagagatccttcactattgccgtgaaaacggcttgagctaccggacggatgaaagcaacgccaaagatgactacacaagaaacagattcagaagaacagtgctcccgtttttgaagcaggaatctccggatgtgcataaaaggtttcagaaagtgagtgaagcactgacggaagatgagcaattcttacagtcattaacgaaagatgaaatgaataaagtaatcacaagccagtctaatacatcagttgaaatcaattcctctcaattgcttgccctcccgatgcctttacaaagaagaggagttcaactaatattaaactatctttatgaaaacgttccatcatccttttcagcccatcacattcagcagtttctcgattgggcggaaaatggcagtccttcaggagtactggactttccgaaaggactgaaggtggtcaaatcatatcagacatgtttgtttacatttgaacaatggcagtgcaaaaatgttccctttgaataccaaattagcggagcttctgatgaaacggcagtgctccctaatggatatctgatagaggcaaggcattatgcggactcgcctgaagaacatgggaatgctgtttttatcacaagtgaaaaaaaggtgcgatttcccttaacaatccggacgagaaaagctggagaccggatcaaactaaaagggatgaacggctcaaaaaaggtaaaggatatatttattgataagaaactgcctctccaagaaagagacaactggccgattgtgacggacgcaagcggtgaaattatctggatacctggcttgaaaaaatcaatttttgaagatcttgtgattccaaacagcgaccgcattgtattacaatatagacagcatgaaaagtgtagggggcaagcaaaatcatgatgaaacatgatatcgagaaagtactgatctcagaggaagagatacaaaagaaagtaaaagagttaggtgcagaattaacgagcgagtatcaagatacatttccgttggcaatcggtgtgttaaaaggagcacttccttttatggcggatcttatcaagcatattgatacatatttggaaatggatttcatggatgtatcaagctacggaaattctacggtttcttctggagaagtaaaaatcattaaagatttggatacatctgtagagggccgggacatcttaattattgaagatatcatcgacagtgggttaaccttaagttatctcgtagagctcttccgataccgtaaagcaaaatcaattaagattgttacccttttggataaaccgagcggaagaaaagcggacatcaaagcagactttgtcggttttgaagttcctgacgcgtttgtagtgggttacggacttgattatgctgagcgctatcgcaatctgccttatatcggagtgttaaaaccggcagtttatgaaagctgatcggcagcctgcttccgagatggttattgtttgtattggaatgattttctatggtactattgaacatagttgtgcttactgtgggaggaggtaaggaatgaatcgggtcttccgtaataccattttttatttacttattttattagtagtaatcggggttgtgagctacttccagacctcaaatccgaaaacagaaaatatgtcgtacagtacgttcatcaaaaacctggatgacgggaaagttgatagcgtatcggttcagcctgtcagaggtgtttatgaggtaaaagggcagctgaaaaactacgacaaagatcaatactttttgactcatgttcctgaaggaaagggagcagaccagatatttaacgctttgaaaaagacagacgtaaaggttgagcccgcgcaagaaacaagcggatgggtgacgttcctgacgaccatcatcccatttgtcattatctttattctgtttttcttcctgctcaatcaggctcaaggcggcggcagccgtgtcatgaactttggcaagagtaaagcgaagctgtatacagaggaaaagaaacgcgtcaaatttaaagacgttgcaggggcagacgaagaaaagcaagaacttgttgaagttgttgagtttctgaaagatccccgcaagtttgccgagctcggcgccagaataccgaaaggcgtgcttttagtcgggcctccgggtaccggtaaaacattgcttgccaaggcttgtgcgggagaagccggcgtacctttcttcagcatcagcggatctgatttcgttgaaatgtttgtaggggtcggtgcttcccgtgtgcgtgacttgtttgaaaatgcgaaaaagaatgcgccttgtttgatcttcattgatgaaattgacgcagtcggacgccagcgtggcgctggtctcggcggtggacacgatgaacgtgaacagacgctaaaccaattgcttgttgaaatggacggattcagcgctaatgaaggaattatcatcattgctgcgacgaaccgtgcggacatcttggacccagccttacttcgtccgggacgttttgaccgtcaaatcacagtggaccgcccagatgtcattggccgtgaagctgtattgaaagtccatgcgagaaacaaaccgctggatgaaacggttaacctaaaatcaattgccatgagaacaccaggcttctcgggcgctgacttagaaaacctcttgaatgaagctgcgcttgtagcagctcgtcaaaacaagaaaaaaatcgatgcgcgtgatattgacgaagcgacggaccgtgtaattgccggacccgctaagaagagccgcgttatctccaagaaagaacgcaatatcgtggcttatcacgaaggcggacacaccgttatcggtctcgttttagatgaggcagatatggttcataaagtaacgattgttcctcggggccaggctggcggttatgctgttatgctcccaagagaagaccgttatttccaaacaaagccggagctgcttgataaaattgtcggcctcttgggcggacgtgttgctgaagagattatcttcggtgaagtcagcacaggggcgcacaatgacttccagcgtgcgacgaatattgcaagacgaatggttacggaattcggtatgtcagaaaaactgggaccgttgcaatttggacagtctcagggcggtcaggtattcttaggccgtgatttcaacaacgaacagaactacagtgatcaaatcgcttacgaaattgatcaggaaattcagcgcatcatcaaagaatgttatgagcgtgcgaaacaaatcctgactgaaaatcgtgacaagcttgaattgattgcccaaacgcttctgaaagttgaaacacttgacgctgaacaaatcaaacaccttgtcgatcatggaacattacctgagcgtaatttctcagaagatgaaaagaacgatgatgtgaaagtaaacattctgacaaaaacagaagaaaagaaagacgatacgaaagagtaattcgctttctttctaaataaactgccggctgacgctggcagtttttttatgtaaatgatgggctcagctgcggcttttacaatcatccaaatctggtatcgatttgtttacaaatgagccgctgatcgtgtatggtattgtagaatgtttgtaaaagtaaagtagagaaactattcaaaagtggtgatagaggttgttactggttatcgatgtggggaacaccaatactgtacttggtgtatatcatgatggaaaattagaatatcactggcgtatagaaacaagcaggcataaaacagaagatgagtttgggatgattttgcgctccttatttgatcactccgggcttatgtttgaacagatagatggcattattatttcgtcagtagtgccgccaatcatgtttgcgttagaaagaatgtgcacaaaatactttcatatcgagccgcaaattgttggtccaggtatgaaaaccggtttaaatataaaatatgacaatccgaaagaagtgggggcagacagaatcgtaaatgctgtcgctgcgatacacttatacggcaatccattaattgttgtcgatttcggaaccgccacaacgtactgctatattgatgaaaacaaacaatacatgggcggggcgattgcccctgggattacaatttcgacagaggcgctttactcgcgtgcagcaaagcttccgcgtatcgaaatcacccggcccgacaatattatcggaaaaaacactgttagcgcgatgcaatctgggattttatttggctatgtcggccaagtggaaggaatcgttaagcgaatgaaatggcaggcaaaacaggaaccaaaggtcattgcgacaggaggcctggcgccgctcattgcgaacgaatcagattgtatagacatcgttgatccattcttaaccctaaaagggctggaattgatttatgaaagaaaccgcgtaggaagtgtataggaggtttagtaatggattatttagtaaaagcacttgcgtatgacggaaaagttcgggcttatgcggcgagaacgactgatatggtaaatgaggggcagagacgccatggtacgtggccgacagcatccgctgcattgggccgcacaatgacagcttcacttatgctcggcgctatgctgaagggcgatgataagctgaccgtgaaaatcgagggcggaggtccaatcggagctattgtagctgatgccaatgccaaaggagaagtcagagcctatgtctctaacccgcaagttcattttgatttaaatgaacaaggaaagcttgatgtcagacgtgcggttggaacaaacggaacgttaagtgtcgtaaaagatttaggtttgcgcgagttcttcacaggacaagtagaaatcgtttcaggagaattaggagatgatttcacttactatcttgtatcatctgagcaggttccttcatcagtgggcgtaggtgtgctcgtgaatcctgacaataccattcttgcggcagggggctttattattcagctgatgccgggaacagatgatgaaacaatcacaaaaattgaacagcgtctatctcaagtagagccgatttctaagctcatccaaaaagggctgacaccagaagaaattttagaagaagtcctaggcgagaaacctgagattttggaaacgatgcctgtcagattccattgcccttgttcaaaagaacggttcgaaacagccattttaggactaggcaaaaaagaaattcaagatatgatagaagaagatggacaagccgaagcagtatgccatttttgtaatgaaaagtacttatttacaaaagaagagctggaagagcttcgtgaccaaactacccgctaagctctttagcgggtttttaatttgagaaaaggggctgaaagcaggtttgaaatcaagaacaatctggaccattattttaggggcgctgttggtttgctgtattgctgttgcatatacgctgacgaaatcccaagctggcgcatcgtcatccggtgagtctattgcgactatcggaggcaagagtgtgacaagagaagaatggctgaaagaaatggaagatcagtatggtaagtcaacgcttgaagatatgatcaatgtccgagttgttgagcagctggctaaaaagaacaaccttaaaatatccaaaagcgaagttgatcgtgagtttttgctgattaaagcggtcaataattccttttacgaagatgaacatacgacggagaaagagtggaaagaccaaattcgttataatatcctccttgaggaattgttaacaagggatatcgatatctcaaacaaagaattggaatcattctataataaaaataaggaactatatcagtttgatgattcgtatcgaattcggcacattgttgtaaaagatgaagaagaagcgagagaagtcctgaaagaactgaaaggcggatcaagctttgaagctgtcgctgccgaaagatctacagacagatatacatcaccatacggcggagatttaggttttgtcacagaggcatcagacaacattccatcagcatacattgaagaggcgaaaacactcaaagaggatgaatggtctcaggaaccaataaaggtcagcaacggatatgccattatccaactgaaagaaaaactaaaggcaagaacgttctcatttgatgaagtaaagggccagatcagacggcaaatcgcaatggatcagctaggtgataaagcgacagttaagacactttggaaagaagctgatgtatcttggttttatggggaaaaaagtactaagtgattgacaaaaaattttgaaattgatagattatatacataataccaatacaaatagtcggaaattgaggtgtcgagaatggtacgtgtagcaaactccattactgaattaattgggaatacgccaatcgttaaattaaatcgccttgcagatgaaaacagtgcggatgtatatctaaaacttgaatacatgaaccctggaagcagtgtaaaagaccgtatcggtttagccatgattgaagcggctgaaaaagaaggaaaattaaaagccggtgatacaatcattgaaccgacaagcggaaatactggaatcgggcttgcaatggttgctgctgctaaaggattaaaagccattttggttatgcctgatacaatgagcatggagcgccgcaaccttcttcgcgcatacggtgctgagcttgtgctgactcctggtgcggaaggcatgaaaggtgccattaagaaagctgaagagcttgctgaaaagcacggatactttgtgccgcagcagtttaacaacccttctaaccccgaaattcaccgccaaacaacgggtaaagaaatcgttgagcaattcggtgatgaccagcttgacgcatttgtagccggaatcggaacgggcggaacgattacgggagcgggcgaagtgctgaaggaagcatacccttccatcaagatttatgctgttgaaccgtcagattccccagtgctttcaggaggaaaaccaggcccccacaaaattcagggaatcggagcgggattcgtgccggacatcttaaacactgaagtatatgatgaaatcttccctgtgaagaatgaagaagcattcgaatatgcccgcagagctgcacgtgaagaaggaattctcggaggcatctcatcaggtgcggcaatttatgctgctcttcaagtagcaaaaaaactcggaaaaggcaaaaaagtattggccatcattccaagtaacggcgaacgttatctaagcacgccgctgtatcaattcgattaaaaaaagccaaaactcccggtccgccgggagtttttttatatttcgtgcatcaaatatgccatgtctgcgacgaatgttattcttggaagagaaattcacttttttcactaacaacattgctttacaattaaaaacaagtaaaaaagaaaatagaggaatgatacaaatggcacaacgcagaccggcaggcaaaaaaataccttttcaaaaagactcattcttacaacaatttgagaaacttgcgcaatcccggaaacatcatgtacttctcgaaagtgcaagaggcggcagatacagtatagccggtcttgatccaattgcgactgtgaaaggaaaagacggaataactacaattaagcatggtgatgagatgctgtttaaagaaggtgatccattacgggccttccacagctggtttaaaacgctggaaacagaaacaaatcatgagttccctgactttcaaggcggggcaatcgggtttctcagctatgattacgcacggtacattgaaaattttaaaatgctctcattagatgatctagaaacaccagatatttattttcttgtttttgatgatatagcagtttatgaccatcaagaagagtctctatggctgattactcatgttaatggttctgatcaggaaacagcgaatgtgaagctatctgagttagagcagatgtggctgactgagcttcccgctgtctcttcgcgagagatgaaccctgaaacagatggttctttcgcggcgccatttaccgaggatgggttctcgcaagctgtagagaaaatcaaacaatacattgccagcggagatgtgtttcaagtcaatctatcaataaggcagtcacagtcactgtctgcccacccatatcaaatttacaaaaccttgagagaagtaaatccttctccttatatggcgtatttagaaacacctgatttccaaatcatttgcggctcgcctgaactgcttgtcagcaaaaagggcaagctattagagacgagaccgattgcgggcacccgttccagagggaaaacaaatgaagaagacgaggtgcttgcaaacgaattgatacacaatgaaaaagaacgcgcggaacatgtcatgctggttgatcttgagcgaaatgatctgggaagagtatcacggtacgggtctgtgcgcgtaaatgaattcatggcaattgaaaaatactcgcatgtgatgcacattgtgtctaatgtccaaggtgaactgcaggatgggtatgatgctgtagatattattcatgctgtattccccggaggaaccattactggtgcaccgaaagtaagaacgatggaaattatagaagaacttgagccgacacgccgagggctttatactggatctataggatggtttggatataatcacgatctgcagtttaatatcgtcattcgaaccatttatgcaaccggagggcaggcatttatgcagtccggcgcaggagttgtgattgattctgttccgaagcacgaatacaaggaatcattcaaaaaagcttttgcgatgcaaagagcattagagctgagcaaagaagagacaaaaattagatgaggtgagcggagaaatgattttaatgattgataactacgattcattcacgtacaacttggtacagtatttgggcgagcttggggaagagctggttgtgaaacgcaatgacagcatcacaatcgaagaaattgaagaactgtctccggactttctgatgatatctcccggaccgtgcagccctgatgaggcgggaatcagcctcgaagcgattaaacatttcgcagggaaaattcctattttcggtgtatgtctcggacaccagtccatcgcacaagtgttcggtggtgacgttgttagggcagaacggcttatgcacgggaaaacctcggatatcgagcatgacggcaagaccatttttgaagggttgaaaaacccccttgttgcgacgcgataccactcgctgatcgtaaaacctgagacgctgccaagctgttttacagtaacagcacaaacgaaagaaggagaaatcatggctattcgccacaatgacctcccgatagagggcgtgcaatttcacccagagtctattatgacctcctttgggaaagaaatgctcagaaattttattgaaacatatcgcaaggaagttattgcgtgatgatatatgtgaacggccggtatatggaggagaaagatgcagttctttctccttttgaccatgggtttttatatgggatcggtgttttcgaaaccttcaggctctacgaaggctgtccgtttttgcttgattggcatatagaaaggcttgaacgcgcgcttaaggatctgcaaatcgaatatactgtttcaaagcatgagatccttgagatgctggacaagctgcttaagctaaatgatatcaaggatggcaatgcccgcgtcagactgaacatatcagcggggatcagcgataaaggctttgtcgcccagacgtatgataagccgaccgttttatgctttgtgaatcagctgaaaccagaaagccttcctttgcaaaaagaagggaaggttttatcgatacggagaaacactcctgagggatcgttccggttaaaatctcatcattatctaaataatatgtatgcgaaacgggaaattggaaatgatccacgtgtcgagggaattttcctaacggaggatggagctgttgcagagggtatcatatctaatgtcttctggagaaaaggtcgctgtatctatacgccatcgcttgatactggtattctggacggcgtcacgagacgttttatcatagaaaatgcaaagaatatcggcctggagctcaaaacgggccgatatgagccagaagctctcttgacagctgacgaagcgtggatgacgaactcggttcttgaaatcatcccgtttactaaaatagaagaagtaaactatggaagccaaagcggagaagcaacctccgctcttcaattgttatacaaaaaagaaataaagaacatgattcatgaaaagggaggaagagcatggcgcagcacacaatagatcaaacacaagtaatccacactaagcccagcgctttatcatataaagagaagacgctggtgatgggaattttaaacgtaacgcctgactctttctcggacggcggaaaatatgacagcttagacaaggcgctgctgcacgcggaagagatgatcaatgatggtgcccatatcattgatatcggaggggaatcgacaaggcctggcgctgagtgcgtatctgaggatgaggagatgtccagagtcattccggtgattgagcggattacgaaagagcttggtgttcctatttctgtagatacgtacaaggcttctgtcgcagatgaagcagtgaaagccggcgcatccattatcaatgatatttggggtgctaaacatgatccgaagatggcttccgttgcagctgaacataatgttccaattgttctcatgcataaccgccctgaaagaaactacaatgacttattgccggatatgctgtcggacttaatggagagtgtaaaaattgctgttgatgccggagtagacgagaagaacattattcttgatcccggtatcggtttcgcgaaaacctatcacgataacttggcagtgatgaacaaactagagattttcagcgggctggggtatccggttcttctggcaacctcccgaaaaagattcatcggacgtgttctggatcttccgcctgaggagcgggctgagggcacaggcgcgactgtgtgtctcggcattcaaaaaggctgtgacattgtcagggtccatgatgtaaagcaaattgccagaatggcgaaaatgatggacgcgatgctgaataagggaggggtgcaccatggataaagtttatgtagaaggtatggagttttacggatatcacggtgtgttcaaagaagaaaacaaacttggccagcggtttaaagtcgatttaaccgctgagctggatttaagcaaagctggacaaacagacgaccttgagcaaacgatcaactatgctgagctctatcacgtatgtaaagatatcgtggaaggggagcctgtaaaattggtagaaacgctggcggaacgtattgctggcactgttctcgaaaaatttcagcctgttcagcaatgtacggtgaaagtgattaagccagacccgccaattcccggacactataaatcagtagcaattgaaattacgagaaaaaagtcatgaacaacatagcttatattgcacttggatctaatattggagatagagaaacgtatttaaggcaagcagtggcttcactgcatcagcatgctgcggtgacagtcactaaagtgtcgtctatttacgaaactgacccggtcggatacgaagatcaagctcaatttttgaatatggctgttgaaatcaagacatcattgaacccttttgaactccttgaactgacgcagcagatagaaaatgaattaggcagaacaagggaagtaagatgggggccgcggacggcagaccttgacattttgttatttaatcgtgaaaatattgaaacagagcaactaattgttccgcatccgagaatgtatgagcgtttgtttgtccttgcgccgcttgcggaaatttgccagcaggttgaaaaagaggctacaagcgccgaaacagaccaagaaggtgtaagagtatggaagcagaaatctggggtagacgaattcgtgcattcagaaagctgaaaggttatactcaagaaggatttgcaaaagcattaggtatatcagtttctattctcggcgaaattgaacgcggaaaccgattgccgtcagctgccataattcaagatgcagcagatgttttaaatataagtgcggacgaattggcgccgccagaaaaatagaacaaatgaaaggaggagaaaaattgttcaaaatcggagatattcaattgaaaaaccgggttgtgctcgcacctatggctggtgtctgcaactctgcgttcagattgactgtaaaggaattcggagccggattggtatgcgctgaaatggtcagtgacaaagcgatcctttacaacaatgcaagaacaatgggtatgctttatatcgatgaacgtgagaaaccactcagccttcaaattttcggaggaaaaaaggaaacccttgtggaagcggcgaagtttgtagaccaaaacacaactgctgatatcattgacattaacatgggatgtcccgtgccgaagattacaaaatgcgatgcgggagccaaatggcttctcgatcctgataagatttacgaaatggtttctgcagtagtggatgctgttaataaaccagttacagtgaaaatgagaatgggctgggatgaagaccacattttcgcagtgaaaaatgcacaggctgtagaacgtgcgggtggtaaagcagttgcgcttcacggccgtacgagagtgcagatgtacgaaggaacggcaaactgggatatcatcaaagaagtaaaacaatcagtatcgattccggttatcggaaacggcgatgttaagacaccgcaggatgctaagcgtatgctcgatgagacaggagtagacggggtcatgatcggacgcgctgcattgggcaacccgtggatgatttaccgtacggttcagtatcttgaaacaggtgaattaaaagaagagccgcaagtacgcgaaaaaatggccgtatgcaaactgcatcttgaccgcctgattgacttaaaaggtgaaaacgtagcggtaagagaaatgagaaagcacgctgcatggtatctgaaaggcgtgaaaggcaatgcgaacgttcgtaatgaaatcaatcattgcgagacgagagaagagtttgtacagcttttagatgcatttacggttgaagttgaggcaaaagagcttcaaaatgcaaaagtaggataatactcacctctatttgctgctcactgctagttttacgctggcagtttttctgcttttttcatgaaacaatatctgtaatggagtgataacaatgagtcaagaagagcataaccatgaagaattgaatgatcagctgcaagtcagacgcgataaaatgaatcagctgagagataacggcatcgatccattcggcgcacgttttgaaagaactcatcagtctcaagaagttatttcggcatatcaagatctaaccaaagaagagttggaagaaaaagcgattgaagttacaatcgcaggccgcatgatgacaaaacgcggcaaaggaaaagccggctttgcccatcttcaggatttagaaggccaaatccaaatctacgtaagaaaagacagtgtcggtgacgaccaatatgaaatcttcaagtcttctgacctcggtgatcttatcggcgtaaccggaaaagtcttcaaaacaaatgtaggcgaattgtctgttaaagcaacttcctttgaattgctgacaaaagcgcttcgtccgcttcctgacaaataccatggtttaaaagacgttgagcagcgctaccgtcagcgctacctggatcttatcgtaaacccagacagcaaacatacgtttattacacgaagcaagatcattcaagctatgagaagataccttgatgatcatggatacttagaagtagaaacacctacaatgcacagcattcctgggggagcttctgcacgtccgtttatcactcaccacaacgcgttagacattccactctatatgcgtattgctatcgaactgcacctaaaacgtctaattgtcggcggtttagaaaaagtatatgaaatcggccgtgttttccgtaacgaaggtgtctctacacgccataaccctgaatttacaatgattgagttatatgaagcatatgcggactataaagatatcatgagcttaactgaaaaccttgtcgctcatatcgcccaagaagtgcttggcacaactacgattcaatacggggaagagcaaatcgaccttaaaccggagtggaaaagaatccatatggttgacgcagtcaaagaagcgaccggcgttgatttctgggaagaggttactgttgaacaggcgcgtgaatatgcaaaagaacatggagtagaaattaaagactctatgacagtaggccatatcatcaacgaattcttcgaacaaaaaattgaagaaacgcttattcagccaacgtttatttacgggcatcctgtagaaatttctcctcttgctaagaaaaaccctgaggacccgcgttttacagaccgttttgagctgtttatcgttggccgtgaacatgccaacgcgtttacagagctgaatgatcctattgatcaaagagaacgctttgaagcgcaattaaaagagcgtgaagccggtaatgatgaagctcatctaatggatgaagactttgttgaagctctggaatacggtatgccgccaacaggaggtttaggcatcggtatcgaccgtctggttatgctgctgacgaatgccccttctattcgcgatgtgctgttattcccgcaaatgagacaacgctaataaagaagagcggtatcctccatagagaaaggatgccgctctttttaaattccttagtatttcttcaaaaaaactattgcactattatttactaggtggtatattattattcgttgccgctaaacaaggcgataacgaaaaaataacttaaaaaaagttattgacttcactgagtcaacgagttataataataaagtcgcttgaacgaagtgaacaaaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaatacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacatctgttatctagttttgagagaacactctcaatttgtttggtggcgatagcgaagaggtcacacccgttcccataccgaacacggaagttaagctcttcagcgccgatggtagtcggggggttccccctgtgagagtaggacgccgccaagcaattgcacgttagtgcaattatggaggattagctcagctgggagagcatctgccttacaagcagagggtcggcggttcgagcccgtcatcctccaccattatgccggtgtagctcaattggtagagcaactgacttgtaatcagtaggttgggggttcaagtcctcttgccggcaccacttttatatgatataatactcaagtctcttgtagaagagccattagctcagttggtagagcatctgacttttaatcagagggtcgaaggttcgagtccttcatggctcaccattttacgcgggtgtggcggaattggcagacgcgctagacttaggatctagtgtctttatgacgtgggggttcaagtcccttcacccgcattatataggataacagttagaaaaactggacatcctgtctgcggaagtagttcagtggtagaacaccaccttgccaaggtgggggtcgcgggttcgaatcccgtcttccgctccaactataccatccacgccggggtggtggaattggcagacacacaggacttaaaatcctgcggtaggtgactaccgtgccggttcaagtccggccctcggcattatgttttgcgcccgtagctcaattggatagagcgtttgactacggatcaaaaggttaggggttcgactcctctcgggcgcgccatattttttaatagaatagatgggaaatcgggaagtagctcagcttggtagagcacatggtttgggaccatggggtcgcaggttcgaatcctgtcttcccgaccattttttatggggccttagctcagctgggagagcgcctgctttgcacgcaggaggtcagcggttcgatcccgctaggctccaccaaaagttttttaaaaaagttgttgactttgaagaagtgacgttgtataatgataaagttgctttaacaaagcagacaaacaaaatgatctttgaaaactaaacaagacaaaacgtacctgttaattcagtttttaaaaatcgcacagtgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaatacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacatctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcaagcttaaacccagctcaatgagctgggttttttgtattttggtttattggtatcataaaattccacttaactgtataatataataactttataccgaattttaaatcagcaatcaggttttgtggaccgggaaaatggaaataatgaaggatagagcgagaaagttgaaaattctcgagaaacggcttatagtaagattaaagtcaaatatagtcaaagtcagtaaaggagggggttgagtgggacataatatttctgacatcattgaacaatatttaaaacgagtgttagatcaaaatggcaaggaaattttagagattaaacgaagtgaaattgcagataaatttcaatgcgttccttcccaaataaattatgtcatcaacaccagatttacaagcgaaagaggatatattgttgagagcaaacgcgggggtggcggttatatcagaatcattaaaattaaaatgaacaatgaagttgtcctgatcaataatattatttctcaaattaatacccatttgtctcaagcagcctctgatgacattattttaaggctattagaagacaaggtaatttcagaaagagaagcaaaaatgatggtcagcgtaatggaccgctcagttttacacattgacttgcctgaacgtgatgaattaagagcgagaatgatgaaggcaatgctgacttctttaaaattaaaataagcgggtgaaaagattgatttgtcaagagtgccacgagagaccagccacttttcactttacaaaggttgttaacggagaaaaaatagaagttcatatttgtgaacaatgtgccaaagaaaatagtgattcatatggtataagtgcaaatcagggtttctctattcataatttactttcgggtttactgaacatggattcttcatttcaaaatgcaggaactcaaatgttcagtcactcggagcaaatatctgcttgtccgaaatgcggaatgacttttcagcaattcagaaaaattggccgttttggatgttctgaatgttacaaaacatttcatagcaacattacacctatcctacgtaaagtgcacagcggaaacactttgcatgcagggaagataccgaaacgaataggcggcaatcttcatgtcagacggcagattgatatgctaaaaaaggaattagaatccttaatccatcaagaagaatttgaaaatgcagctcatgtaagagatcaaattcgttcattagaacaatcactcaaaagtacagatagtgaggaggaacaggagtaatgtcgctaaagcattttattcaggacgcactaagcagttggatgaagcagaaaggacctgaaagtgacattgtactcagcagccgcatacgtttagcaaggaactttgagcatattcggttccctacgcggtattccaatgaagaagcctcatccatcatacagcaatttgaagatcagttttcagagcaagaaattcccggaatcggcaaatttgttttgattagaatgaatgatgcacagcctttagaaaagcgtgtacttgttgaaaaacatctaatcagtcctaatctgacagagtctccttttggcggctgtttgctttctgaaaatgaggaagtaagtgtcatgttaaatgaagaggaccatattagaattcagtgtcttttccctggatttcagcttttagaagcaatgaaagccgcaaaccaggtcgacgactggattgaagaaaaagttgattatgcattcaatgagcaaagaggatacttaaccagctgtcctacaaacgtaggtacaggtttaagggcttcggtcatgatgcatctgccggcactggttttaactaggcaaataaatcgaattataccggcaattaatcaattaggcttagttgttagaggaatttatggggaaggcagcgaagcagtagggaatatctttcaaatttcaaatcagatcacgcttggtaagtcagagcaggatattgtagaggatcttaacagtgttgctgctcagttgattgaacaagaacgatctgcccgagaagcgatttatcaaacttctaaaatcgaacttgaggatcgggtatatcggtcttatggggtcttgtctaattgccggatgatagaatcgaaagaaactgcaaagtgcctttcagatgttcggttaggcatagacctaggcattataaaaggactttcaagcaacatacttaacgaacttatgattttgacgcagccaggatttttacagcaatactcgggaggcgctttgcgtccgaacgaaagggacattcgaagagcggctctcatcagagaacggcttcacttagaaatgaatgggaaacgacaggaggatgaatcgatatgatgtttggaagatttacagaacgagctcaaaaagtactggcgctagcacaggaagaagcacttcggttaggtcataataacattggcactgagcatattttattaggactggtaagagaaggagagggcattgctgctaaagctcttcaagcgcttggactcggttcagataaaattcagaaagaagtagaaagtttgatcgggcgcgggcaggaaatgtctcaaacgattcattatactcctagagctaaaaaagtcattgagctttcaatggatgaggcaagaaaactcggtcattcttatgttggaacagaacatattcttcttggactgattcgtgaaggagaaggtgttgctgcgagagttttgaataatctcggtgtcagcttaaataaagcaagacagcaggtgctccagcttctaggaagtaatgaaacaggatcatcagcggcaggaacaaacagcaatgcgaatacgcctacgcttgacagcttggcaagagacttaactgctattgcgaaggaagacagccttgaccctgtaatcggcagaagcaaggagatccagcgtgtcattgaagtattaagccgcagaacgaaaaacaaccctgttctcattggggaaccaggtgtaggtaaaacggctatcgcagaaggtttggcacagcaaattatcaataatgaagtacccgaaattttgcgtgataaacgtgtgatgacattagacatgggaacagttgttgccggcacaaaatatcgcggagaatttgaggatcgcctgaagaaggtcatggatgaaattcgccaggcaggaaatatcattctattcatcgatgagctccatacattaatcggggcaggcggagcagaaggtgctattgatgcatctaatattttaaaaccttcacttgctcgcggcgaactccaatgtattggtgcaacgactcttgatgagtaccgtaaatatattgaaaaagatgcagcactggaacgccgttttcagccgattcaggttgatcagccatctgtagatgaaagtattcaaattttacaaggtctgcgtgacagatacgaagcccaccaccgcgtttctatcactgatgatgccattgaagctgcggttaagctttctgacagatatatttctgaccgcttccttccggataaagcaattgacttgatcgatgaagcaggttcaaaggtgagactgcgctcatttacaacgcctcctaacttaaaagagcttgagcagaagcttgatgaggttcgtaaagagaaggatgcggcagtgcaaagccaagagtttgaaaaagctgcttccttgcgtgatactgaacaacgcctgcgcgagcaagtagaggatacgaagaaatcatggaaagagaagcaagggcaggaaaactcagaggttactgtggatgatattgcgatggttgtatccagctggaccggtgtgcctgtatctaaaatcgcccaaactgaaactgataagcttctcaatatggaaaacattcttcattcccgcgtcatcggccaggatgaggcagttgtagctgttgcaaaagccgtcagacgtgcgagagcagggttgaaagatcctaaacgcccaatcggctcattcattttcttaggccctacaggtgtaggtaaaacagaacttgcacgagcacttgctgaatccatttttggcgatgaagaatccatgatcagaattgacatgtctgaatacatggaaaaacactcaacttcaagacttgttggttcacctccgggatatgtgggatatgatgaaggcggtcaattgacagagaaagtcagaagaaaaccttactctgtcgtgcttcttgatgagatcgagaaagcgcaccctgatgtcttcaatatccttctgcaagttcttgaagacgggcgattgactgattctaaaggacgcacagtcgatttccgcaataccattctgatcatgacatcaaacgtcggagcaagtgagctgaaacgcaataaatatgtcggctttaacgttcaggatgaaactcaaaatcataaagacatgaaagataaagtgatgggtgaattgaaacgagcgttcagacctgagttcatcaaccgtattgatgaaatcattgtcttccattcacttgagaaaaaacatcttactgaaattgtgtcattaatgtctgatcaattaacgaaacgcctgaaagaacaagatctttctatcgaattgacagatgctgcaaaagcgaaagtcgcggaagagggcgttgacctggaatacggtgcccgtccgttaagaagagcgatccaaaaacatgtcgaggatcgtttatctgaagaactcctcagaggaaatattcataaaggacagcatattgttcttgatgtagaagatggcgaatttgtcgtaaaaacgactgctaaaacgaattaatatagaagacggaaatgaggcatacagcatgtaagtgtatgcctcactttcatatcaagaaatagaacaagggagaggtcttacactatatatggctaaaacaaaatcgaaattcatctgccaatcctgcggctacgagtctccaaaatggatggggaaatgtccgggctgcggtgcttggaatacaatggtggaagaaatgattaaaaaagcaccggccaatcggagagcggctttttctcattctgttcaaactgtacagaaaccttcacctattacatcaatcgaaacatcagaagaaccccgcgtcaaaacccagcttggcgagtttaacagagtactcggcggaggtgtcgttaaaggctccctcgttttaattggcggtgatcctggtatcggaaagtcaacgctattactgcaggtttccgctcaattatcaggctcatcaaacagtgtcctgtatatttcgggagaagaatctgtaaagcaaacgaagctgcgagcagaccgtctcggcattaataatccgtcactgcatgttttatctgaaaccgatatggagtatatttcgtctgctatacaagagatgaatccagcgtttgtcgttgttgactctattcaaacggtttaccaaagcgatattacatcggctccaggcagtgtgtcacaggtcagagaatgtaccgctgagctgatgaaaattgcaaaaacaaaaggtattccgatttttatcgtagggcacgtaacgaaagaagggtctattgcaggtccaagactgttggagcatatggttgacactgttttatattttgaaggagaacgccaccatactttccgtattttgcgggctgtaaaaaaccgtttcggatctacaaacgaaatgggcattttcgaaatgcgggaagaggggctcactgaggttttgaatccttcggaaattttcttagaagaacgctctgctggttccgcaggctcgagtatcactgcctctatggagggcactagaccgattctcgttgaaattcaggcgctcatctcgccaacaagctttggcaacccaaggcgtatggcaacgggaatagaccataacagggtctctctgttaatggctgtgttagaaaaaagagttggactgctgctgcaaaatcaggatgcttatttgaaagtggctggcggcgttaagcttgatgaaccggcaattgatcttgccattgcgattagtatcgcatcaagctttagagacacacctccaaatcctgcagattgttttattggagaagtgggattaaccggagaagtccggcgggtttcaagaattgaacagcgtgtgaaagaagcggcaaagcttggttttaaacgcatgatcatacccgcggcaaatctggatggatggacaaaaccaaaagggattgaggttatcggagtagcaaatattgcagaagcgcttcgtacttcattaggaggataatagatggaaaaagagaaaaaaggggcgaaacacgagttagacctgtcatctatattgcagtttgttgctccgggtacaccgctcagagcggggatggaaaacgtcttgagagcaaatacaggcggtctgattgttgttggatataatgataaagtaaaagaagtggtggacggcggctttcacataaacacggctttttctccggcgcatttatatgagctggctaaaatggatggagcgatcattttaagtgattctggtcaaaagatcctctacgcgaatactcagctgatgccggatgccacaatttcttcatcagaaacaggaatgcggcacagaactgccgaaagagtagctaagcaaactggctgtcttgtaatcgctatttctgaaagaagaaatgtcataacgttatatcaggaaaacatgaagtatacactaaaagacataggatttattttaaccaaggcgaaccaagccattcaaacacttgaaaaatataagacaatcctcgataaaacgattaatgcactgaacgcgttagagtttgaggaacttgttaccttcagtgatgtcttgtctgtcatgcatcgttatgaaatggtactgagaatcaaaaacgaaattaatatgtatatcaaagagctggggacagaagggcatctgatcaaactgcaagtcattgaattgattacggatatggaagaagaggccgctttatttattaaggactatgtaaaagaaaagattaaagatccgtttgttctcttgaaggagctgcaggatatgtccagttatgatctgctggatgattccattgtgtataagcttctcggttaccctgcttctactaatcttgatgattatgtattgccgagaggatacaggctgttaaataagataccgcgtcttccgatgccgattgttgaaaatgttgtagaagcatttggagtcctgccaaggattattgaggcgagtgcagaagaattagatgaagtagagggaatcggtgaagtacgagcccaaaaaatcaaaaaaggattaaaacgcctgcaagagaagcattatttagacagacaactgtgatttcggttaaaaccttatgaatacgggtatattaatgttggtttttgtttattctgatattcgtaggatgcataagactttgtgaaattaaaatgttaaaaaaggaggtgggggtatgttaaaacgaatagttcaggcgttcttcattatttttggcggcgttgttggtatatttttgatacctgaattgtttgtactgttaaatatacaggacatacctttaataacaaacgcatatacgtctgcggcaataggagcaattatcttttttctcatcagtatatggggtacagaatacgttgtgaactgggtgaagtggatagaggattcattgttaaaagcgccggttccagatttgttatttggaagtcttggcttagtttttggacttataattgcttatcttatcgtaaatgttattcctttagacaatataccttaccgcatattcagcacaataattcctgtatttttggctttcttcctcggttatctcggcttccaggtgggctttaagaaaaaggatgaattgatcagcctgttttccatttccgccagaatgcaaaagaaaaaaggaacagctgatgaagaacatgaggttcaagacaagaagctgaaaattttggacactagtgttattattgatgggagaatagcagatatttgtcagactggttttttagagggagttatcgtgattccgcagtttgtccttgaggaattgcagcatattgcagactcttcagatgttttaaaacgaaacagaggacgccgcggtcttgatatcctgaaccgcattcagaaagaattagacattgaagttgaaatttacgaaggcgactttgaagatattcaggaggttgacagcaagctcgtcaaacttgctaagctgacatccggggtcgttgtgacgaatgattttaatttaaataaagtgtgcgagcttcagaaggtagcagtattaaacattaatgaccttgccaatgcggtcaagcctgttgtgcttcctggcgaggaaatgaatgttcaggtcattaaggacgggaaagagcataatcagggagttgcctacttggatgacggtacgatgattgtcgttgaagaaggacgaaattatatcggcaagcatattgatgtactcgtcacaagtgtgctgcagacagcagcgggacgaatgatttttgcgaagcctaagctgttggagaaggcgctgtaaagggagaagaaacaatgagttatgatgtggtgattcctgcagccggacagggaaagcggatgaaggcagggagaaataaactgttcattgatctgaagggagacccggtgatcatacacacgttaagagtgtttgacagccaccggcagtgcgataaaatcattttggtgattaacgagcaggagcgggagcactttcaacacttgctgtccgattacccgttccaaacttcaattgagcttgttgcaggcggagaagagcgtcagcacagtgtgtataaggggctgaaagccgtaaagcaggaaaagattgtccttgtacatgacggtgcccgcccatttataaaacatgaacaaattgacgaactgatcgcagaggcggaacagacaggagcggccatccttgctgttccggtaaaagatacgattaaacgcgttcaagatttacaagtcagtgagacgattgaacgttcaagcttgtgggctgtccaaacgccacaagcttttcgtctttctttattgatgaaggctcacgctgaggccgagcgcaagggatttttagggacggatgacgccagcctcgttgaacagatggagggcggttcggtccgtgttgtagaaggcagctatacaaatattaagctgacgacgccagacgatttgacgtcagctgaagctatcatggaatcagaaagtgggaataaacatgtttagaattggacaaggatttgatgtgcatcaattagtggagggccgtcctctcattattggcggaattgaaatcccgtacgaaaaagggctgcttggccattctgatgcagacgtattgctgcatactgtcgctgacgcctgcctgggagctgtgggtgaaggagacatcggcaagcattttcctgacacagatcccgagttcaaggacgcagattctttcaaattacttcagcatgtctggggaatcgtgaaacagaaggggtatgtccttgggaacattgattgcaccatcatagcgcaaaagccgaagatgctgccgtacatagaagatatgagaaaaagaattgctgaaggccttgaggcagaagtttctcaagtaaatgtaaaagcaacaacgacagaaaagcttggatttacaggccgggcggaaggaatagcggctcaggcgacagtactgatacaaaaaggctaacttgttttgatgccgggtctatttggtggtagaatagattcatacatttttgcctgaggccatacatgacatgaaaggaagtatttgaaaatgggaaacgaagtacgcgtccgttatgcaccgagtccaaccggacatttgcatattggaaatgccagaacggcgctttttaattatttatttgcccgcaatcaaggcggtaagtttatcattcgagttgaggatacagataaaaagcgcaatattgagggcggagaacaaagccagctgaattatctgaagtggctaggtattgactgggatgagagtgtggatgtcggaggagagtacggcccataccgtcagtcagagcgtaacgatatctataaagtgtactatgaagagcttcttgaaaaagggcttgcttataaatgttactgtacggaagaagagcttgaaaaagagcgtgaagaacagattgcccgcggagaaatgcctcgttattccggaaaacacagagacctgactcaggaagaacaggagaaatttatcgctgaaggcagaaaaccaagtattcgtttccgcgtgccggaaggaaaaatcatcgccttcaatgatatcgtaaaaggcgaaatttcttttgaatcagatggcatcggcgactttgttattgtgaaaaaggacggtacgccgacttacaacttcgcggtagcgattgatgactacttaatgaaaatgacacacgtgctgcgcggtgaggatcatatttctaacacaccgaaacagattatgatttatcaagcattcggatgggatattcctcagttcggacacatgacgctgatcgtaaacgaaagccgtaaaaagctcagtaaacgtgatgaatccattattcaattcatcgagcagtacaaagagcttggctacctgccagaagcactgttcaactttatcggcctgttaggctggtcaccggttggagaagaagagcttttcacaaaagagcagtttattgaaatttttgatgtaaatcgtttatctaaatcaccagctttgtttgatatgcataagctaaaatgggttaacaaccaatatgtgaagaagctggatcttgatcaggttgttgaattgacgcttccgcatttgcaaaaagccggcaaagttggcactgagctttctgctgaagaacaagaatgggttcgtaaactgatttccctgtatcatgagcaattaagctacggtgcggaaattgttgagctgactgatttgttctttacggatgagatcgagtataatcaagaagcgaaagctgttctggaagaagaacaggttcctgaagtgctcagtacattcgcagcgaagcttgaagagcttgaggagttcactccggataacatcaaagcatcgatcaaagcagtgcagaaagaaactggccataaagggaaaaaactgtttatgccgattcgtgttgctgtaacagggcaaactcatggtccggaactgccgcaatcaattgaattgatcggtaaagagactgcaattcagcgtttaaagaatatctaaataaatgattgttgacagggaagagtataaagctttaggccattacagaaaggatctccattggctgagagagatccatgagccgggttttagaagtgcgcccttaagacctttgaagaacgttttttgaaatcagtattcaaaggcggccgccgccgttacaggctgaagttgggagagcagaagtctgcttttcaaacagagtggaaccgcgcggttaaagcgtctctgtcatgtttacatgcagaggcgctttttttattgggtagaggaaatcagatagagaaacggggggaagcatgtgttttttagaatgctcaaagaagacattgatactgtgttcgatcaagatcccgcagcaagaagctattttgaagtgattttaacttattccggtttacatgctatatgggcgcatcggattgcacatgctttatataaacgaaaattttatttccttgcacgccttatatctcaagtaagccgattttttaccgggatagaaatccaccccggcgccacaatcgggagaagatttttcatagaccacggcatgggggttgtcattggggagacatgtgaaatcgggaataacgttaccgtttttcagggggttaccctcgggggaacggggaaagaaaagggaaaaaggcacccaacgattaaagatgacgcattgatagccacaggtgctaaagtgctcggttctattacggtcggtgaaggctcaaagattggggctggttcagtagtgctgcatgatgttcctgatttttcaacagttgtcggtatccctggacgggtcgttgtacaaaatggcaagaaagtaagacgcgatttaaaccatcaggatttgcccgatccggttgctgaccgctttaagtctttggaacagcagattttagagctgaaggcagaacttgaagacagaaaagaaaggatcaaccaaaaatgacaatcacactttataatacattgactagacagaaggaaacattcgttcctcttgaagagggaaaagtgaaaatgtatgtatgcggacccacggtttacaattacattcatatcgggaacgcgcgtccggcaatcgtttacgatacggttcgaaactatttagagtataaaggctatgatgtgcagtatgtctctaacttcacagacgtagacgataaactaattaaagcggcaaatgaactcggtgaggatgtacccaccatttcagagcgttttattaaagcatactttgaagacgtaggtgcgctcggctgccgaaaagccgaccttcatccgcgagtaatggagaacatggatgccattatcgaattcgtagatcagctcgtgaaaaagggctacgcatatgaatcagaaggtgacgtatatttcaaaaccagagcgtttgaagggtacggaaagctttctcagcaatcaatcgatgaacttagatcaggtgcacgcatccgagtcggcgagaaaaaagaagatgctcttgatttcgcactgtggaaagcggcaaaagaaggagaaatctcttgggatagcccttgggggaaaggacgtccgggctggcacattgaatgctcagcaatggtgaaaaagtatctcggtgaccagattgatatccatgcgggcggacaggatttaacattccctcaccatgaaaacgaaattgcgcaatctgaggcgctaacaggcaaaacgtttgcgaagtattggcttcataatggttatatcaatattgataatgaaaaaatgtcaaaatcactaggcaactttgtgcttgtgcatgacatcattaaacagcatgatccgcagcttttgagattctttatgctatctgttcattatcgccatccgattaactattcagaagagcttctggagaatacgaaaagcgcgttcaaccgtttaaaaacagcgtacagcaatcttcagcaccgtctgaacagcagtacgaatttaaccgaagatgacgatcaatggcttgaaaaagttgaagaacaccgcaaagcattcgaagaagcgatggacgatgattttaatacggcgaatgccatttcagtcttgtttgacttagcgaaacacgccaattattatcttcagaaagatcatacggctgatcatgtgattacggcgtttattgagatgtttgaccgcattgtttctgtcctcggtttttcgttgggtgagcaggaacttctcgatcaagagattgaagacttaatcgaaaagcgaaatgaagcgcgccggaatcgcgattttgcattgtcagaccagatccgcgaccagctgaaaagcatgaatatcattcttgaagatacggctcaaggcactcgctggaaacggggagaataacagatgcttgaatttgatacgataaaagattctaagcagcttaacggtcttgcgcttgcttatataggtgatgccatttttgaagtgtatgtcaggcatcacctgcttaagcagggctttaccaaaccaaatgatcttcataagaaatcaagccggattgtttcagcaaagtcacaggctgagatcctattttttctgcagaatcaatcattttttacggaagaagaggaagcggtgctgaaaagaggcagaaatgccaagtcagggacaacacctaaaaatacagatgttcagacgtaccgctacagtacagcatttgaagcgcttctgggctacctttttctagagaaaaaagaggaacgacttagtcagctcgtagccgaagctatacaattcgggacgtcagggaggaaaacaaatgagtcagcaacatgattacgtcatagggaaaaatgcagtgatcgagacgttaaaatctgatcggaagctgtataagctgtggatggcggaaaacaccgtaaagggacaagcacagcaagtgattgagcttgccaaaaagcagggaatcacgattcaatacgtcccgagaaaaaaactcgatcaaatggtgacaggacagcatcagggcgtagtggcacaggttgcagcgtatgaatatgcagaactggacgatttatataaagcagccgaagaaaaaaatgaacagcctttcttcctcattctggacgagcttgaagaccctcataatcttggttccattatgaggacagcagatgcggtcggcgctcatggcatcgtcattccaaaacggagagctgtcgggctgacaacaacagtggcaaaagcttcaacaggagcaattgagcacattcctgtagcaagagtcaccaatttggcacggacgttagaagagatgaaagagcggggaatctgggttgtcggaacggatgcgtccgcgcgtgaggattaccgtaatatggacggcaatatgcctttggctctagtcatcggaagtgaaggaaaagggatgggccgccttgtgaaagaaaagtgcgattttctcattaaactcccgatggccggaaaggtaacttcactaaatgcatctgtcgcggctggtcttttgatgtatgaagtctaccggaaacgaaaccctctgggagaataaagacccatggatatcctgttagtagacgggtacaacatgattggagcctggccgcagctgaaggatttaaaagcgaacagttttgaagaggcgagagacgtactgattcagaaaatggcggaatatcaatcgtatacaggaaacagggttattgttgtttttgacgcgcatctcgtaaaagggcttgagaaaaaacagaccaaccatagagttgaagtaatttttacaaaagaaaatgagacggctgatgagcggatagaaaagctcgctcaggctttgaataatattgcgactcaaattcacgttgcgacctctgactatactgagcagtgggcgattttcggacagggggcattgcggaaatcggcccgggagcttttgagagaggtagaaacgattgaaaggcgaatagagagacgggtaagaaaaatcacttccgaaaagccggcgggtaaaattgctttatcggaagaggttttgaaaacgtttgaaaagtggaggcggggagacttagattaagttgacgcttttttgcccaatactgtataatatttctatctacgtgcgccggggggatcggagtgaatctacagaacaacaagggaaaattcaacaaagagcagttttgccagttggaggacgagcaggtcattgaaaaggttcatgttggggacagtgatgcgttagattacttgattacgaagtaccgaaactttgttcgggcaaaagcaagatcctatttcttaataggggcggacagagaggatattgttcaggaaggcatgataggcctctataagtctattcgtgacttcaaagaggacaagcttacctcattcaaagctttcgcagaattatgtattacccgccaaattattaccgcaataaagacagctactcgccagaaacacattcctttgaattcctacgtctcattagataaaccgatttttgatgaagaatcagaccgaacgctgctggatgtcatttcaggagcgaaaaccttaaatcctgaggaaatgatcattaatcaggaagaatttgatgatattgaaatgaaaatgggagaactattaagtgatttagagagaaaagtactcgtcttatatctcgacgggagaagttaccaagagatttctgatgaactgaaccgacatgtgaaatcgatcgacaatgcccttcagcgtgtgaaacgcaagctggagaagtacttggaaattcgcgaaatcagtttgtaataggaatttatgctatattgacagtatttttctgactatgatatgttactaaagataagaactaatgtctatttagaaaaaggtgtaatgacatgagaaaaaagattacgttagcatgcaagacatgcggaaaccgtaattatacgacaatgaagagctctgcatcagcggctgagcgattagaagtaaagaaatactgcagtacttgcaattcacatacagctcatcttgaaacaaaatagtttttgcgcttttaaattgtggaggtcttttacatgcgtattatgaaattctttaaagatgttgggaaagaaatgaaaaaggtaagctggcctaaaggaaaagagttaacgcgttataccattacggtaatttcaacagttatcttttttgttatcttttttgccctccttgacacaggaatttctcaattaattcgtttaatagttgaataatgatcagcaatacgtgctataatagatcataatattacttgccaaaacccgttcagcgggttttttattgtggcttaaaatgaaagttatcataggcttgccgcctattttttgaagcgttatggtaattcactaaaaccaaatgcggggagggaaggactggacagtcctgaatagaatggaaaagaattggtatgttgttcacacgtactctggttatgagaataaagtaaaagccaacttggaaaagcgtgttgaatcaatggggatgcaggataaaattttccgtgtagtcgtacccgaagaagaagaaacggatatcaaaaacggcaagaaaaaagtcgtgaaaaagaaagtattccctggttatgtgcttgttgaaattgtaatgacagacgactcttggtatgtcgtccgcaacacgccgggcgttactggattcgtaggatctgccgggtcaggttcaaaaccgacgccgcttcttccgggggaagcagaaaccattctgaagagaatgggcatggatgaacgaaaaactgatattgactttgaactgaaagagacagtgaaagtgatagacggaccttttgctaactttacaggatcaattgaagagattgattatgataaaagcaaggtcaaagttttcgttaatatgtttggccgtgaaacgccggttgagctggaatttacccaaatcgataaattgtaatgtgaaaaaacttgaaattgctatatataaatgataatatagcaaaggtacgtcttggacttatccaaggcaactagcatgatatttcgtcattcatataaagaatgaaaccttgagtgggagggtttaccctattaccacatcacggacttaaggaggtgtgtctcgtggctaaaaaagtagttaaagttgtaaaattgcaaattcctgctggaaaagctaacccagcaccaccagttggacctgcacttggtcaagccggtgttaacatcatgggattctgtaaggagtttaacgctcgtacagctgaccaagctggtttaatcattcctgttgaaatttcggtttacgaagaccgttcatttacatttattacaaaaactccacctgctgcagtattgcttaaaaaagcagctggaattgagtctggttctggtgaaccaaaccgtaataaagtggcaaccgttaagcgcgataaagtacgcgaaatcgctgaaacgaaaatgcctgacttaaacgcagcagacgttgaagcggcaatgcgcatggttgaaggtactgcccgcagtatgggtattgtaatcgaggattaatttgtttcttgtcgggttgcgagttttaacaagttcgcaacccttattcgtgggaggttattccgctataaccacataaggaggaaattttaaaatggctaaaaaaggtaaaaagtacgttgaagctgctaagcttgtagaccgttctaaagcttacgacgtctctgaagcagtagctctcgttaaaaaaacaaacacagctaaattcgacgctacagttgaagtggctttccgtttaggggttgaccctcgtaaaaacgaccagcaaatccgtggagcagttgtgcttccaaacggaactggtaaaactcagcgcgttctcgttttcgcaaaaggcgaaaaagcgaaagaagctgaagctgctggtgcagatttcgtaggcgatactgactacatcaacaaaattcaacaaggctggttcgatttcgatgtaatcgtagctacacctgacatgatgggtgaagttggtaaaatcggtcgtgtacttggaccaaaaggtttaatgccaaaccctaaaactggtacagttactttcgaagttgaaaaagctatcggcgaaatcaaagctggtaaagttgaataccgcgttgataaagctggaaacattcatgttcctatcggtaaagtttctttcgaggatgaaaaacttgttgagaacttcacaacaatgtacgatacaatccttaaagctaaacctgctgcagctaaaggcgtttacgtgaaaaacgttgctgtaacttctactatgggacctggtgtcaaagtagactcttcaacttttaacgtaaaataatattgacatgacatcaacattctgatattattcaaaatgttgtaaaatagaatatcatttataccgtagacagtaggggcctaaccgcttaattatcctaccgaggtgtatattatcacagctattacgttacgtatgcttgtatatacagcctccatgtctcatggaggctttttatatggaatccgtcgtctcagtcgtgatcacctaacggtataagtgttacacaagaatctacaggaggtgtaaccatgagcagcgcaattgaaacaaaaaaagttgttgttgaagaaattgcttctaaactgaaagaaagtaaatcaacgatcatcgttgactatcgcggacttaacgtttctgaagtaactgaacttcgtaaacagcttcgcgaagctaacgttgagttcaaagtttacaaaaatacgatgactcgccgtgcggttgaacaagctgagcttaatggtttgaatgatttcttaactggaccgaacgcgatcgcattcagcactgaagatgttgtcgctccggctaaagttcttaatgacttcgctaaaaatcacgaagctcttgaaatcaaagctggcgttatcgaaggtaaagtttctactgttgaagaagtgaaagctcttgctgaacttccatcacgcgaaggcttgctttctatgttgcttagcgtacttcaagctccagttcgcaaccttgctcttgctgcaaaagctgtggcagaacaaaaggaagaacaaggcgcttaatctaatcagtttttcataaattaaaacaaaatggaggaattacaaatggctttaaatatcgaagaaatcattgcttccgttaaagaagcaactgtacttgaattgaacgacctagtaaaagcaatcgaagaagaatttggcgtaactgctgctgctcctgtagctgtagctggcggagctgctgctggcggagctgctgaagagcaaagcgaattcgatcttatccttgctggtgcaggatctcaaaaaatcaaagttatcaaagttgtacgtgaaatcactggtcttggcttgaaagaagctaaagaacttgttgacaacactccaaaaccacttaaagaaggtattgctaaagaagaagctgaagagcttaaagctaaacttgaagaagttggcgcttctgtagaagttaagtaatcttcacttacctgtaggggaagctcgcttttatgaggcgagctttttctttgccattctttaagccatgaaaaaaggaggttctaataatgagtgagcactattattcagaaaaaccttcagtaaaaagcaacaagcaaacctggtcttttaggcttcggaataaagatttcacgtttaccagcgacagcggggttttttctaaaaaagaagttgatttcggctcccgcctgctgattgattcttttgaagagcctgaggttgagggcagctttttggatgtaggctgcgggtacggcccgattggtttatcgctggccagcgactttaaagaccggactatccacatgattgacgttaatgagagagccgtagaactatcaaatgaaaatgcggaacataacggaataacaaacgttaagatttatcaaagtgatttgttttcaaacgttgattctgctcaaacatttgcttctattcttacaaatcccccaatccgagccggaaaaaaagttgtccatgctatctttgagaaaagcgctgaacacttaaaagcttcaggtgaattgtggatcgtcatacagaaaaagcaaggcgcgccttctgccattgaaaagctcgaggaactgttcgatgaagtttccgtcgttcaaaaaaagaaaggctattatatcataaaagcaaaaaaagtttgactcggtattttaactatgttaatattgtaaaatgccaatgtatatattttgcttgatatgatgaattgtcaatatctatgtataaattatacaagtatggaaatgctaataaaatcggtatttgtttttggatgtggttttcttaattagaaacccttttttcttttgtcttgtaaaagtattttctttctttggaagaaatgcttattacacatataatacgcatgatttgaggggtgaatcagttgacaggtcaactagttcagtatggacgacaccgccagcgcagaagctatgctcgcattagcgaagtgttagaattaccaaatctcattgaaattcaaacctcttcttatcagtggtttcttgatgagggtcttagagagatgtttcaagacatatcaccaattgaggatttcactggtaacctctctcttgagttcattgattatagtttaggtgagcctaaatatcctgtagaggaatcaaaagaacgtgatgtgacttactcagctccgctaagagtgaaggttcgtttaattaacaaagaaactggagaggtaaaagaccaagatgtcttcatgggtgatttccctattatgacagatacaggtacttttatcattaacggtgcggaacgtgttatcgtttcccagcttgttcggtctccaagtgtatatttcagtggtaaagtagacaaaaacggtaaaaaaggttttaccgcaactgtcattccaaaccgtggcgcatggttagaatacgaaactgatgcgaaagatgttgtttatgtccgcattgatcgcacacgtaagttgccggttacggttcttttgcgtgctctcggcttcggctccgatcaagagattcttgatctcataggagaaaacgaatacctgcgaaatacgcttgataaagataacacagaaaacagcgacaaagcgttgctggaaatttacgagcgtctccgtcctggagagccgcctacagtagaaaatgcgaaaagcttgcttgattctcgtttctttgatccgaaacgatacgatcttgccaatgtaggacgctataaaattaataaaaaacttcatattaagaatcgcctcttcaatcagagacttgctgaaacgcttgttgatcctgaaacaggagaaatccttgctgaaaaaggccagattcttgatagaagaacgcttgataaagtactgccatacttagaaaacggaatcggttttagaaagctgtatccgaatggcggcgttgttgaagatgaagtgactcttcaatcaattaaaatctttgctccgactgatcaagaaggagaacaggttatcaatgtaatcggcaatgcttacatcgaagaagagattaaaaacatcacgcctgctgatattatttcttcaatcagctacttcttcaacctgctgcacggagtaggcgacacagatgatatcgatcatcttggaaaccgccgtttacgttctgtaggcgagcttctccagaaccaattccgtatcggtttaagccgtatggagcgtgtggttcgtgagagaatgtcaattcaagatacgaatacaattacgcctcagcagctgatcaatattcgtcctgttattgcgtccattaaagagttctttggaagctcacagctttctcaattcatggatcagacgaacccgcttgctgaattaacgcacaagcgtcgtctgtcagcattaggaccgggcggattgacacgtgagcgtgccggaatggaagtgcgtgacgttcactactcccactatggccgtatgtgtccgattgaaacgcctgagggcccgaacatcggtttgatcaactcactatcatcttatgcaaaagtaaaccgttttggctttattgaaacgccatatcgccgcgttgaccctgaaacagggaaggtaacgggcagaatcgattacttaactgctgatgaagaggataactatgttgtcgctcaagcgaatgctcgtcttgatgacgaaggcgcctttattgatgacagcatcgtagctcgtttccgcggggagaacaccgttgtttccagaaatcgtgtagactacatggatgtatcgcctaagcaggttgtatctgctgcgacagcatgtatcccgttcttagaaaacgatgactccaaccgtgccctcatgggagcgaacatgcagcgtcaggctgtgcctttgatgcagccggaagcgccatttgttggaactggtatggaatacgtatcaggaaaagactctggtgccgctgttatttgtaaacaccctggtatcgttgaacgcgtagaagccaaaaacgtttgggttcgccgttatgaagaagtagacggtcaaaaagtaaaaggaaacctggataaatacagcctgctgaaatttgtccgctctaaccaaggtacgtgctacaaccagcgtccgatcgtaagtgtcggcgatgaagtggtaaaaggagaaatccttgctgacggtccttctatggagcttggtgaacttgcacttggccgtaacgtaatggtcggcttcatgacgtgggatggctacaactatgaggatgccatcatcatgagtgaacgcctagtgaaggatgatgtttatacatctatccacattgaagaatacgaatcagaagcacgtgatacgaaacttggacctgaagaaatcactcgcgatattccaaacgtcggtgaagatgcgcttcgcaatcttgatgaccgcggaatcatccgtattggggcagaagtaaaagacggagatcttcttgttggtaaagtaacgcctaaaggcgtaactgaactgactgccgaagaacgccttcttcacgccatctttggcgagaaagcccgcgaggttcgtgatacttctcttcgtgtgcctcatggcggcggcggaattatccatgacgttaaagtcttcaaccgtgaagacggagacgaacttcctccaggtgttaaccagttagtacgcgtatatatcgttcagaaacgtaagatttctgaaggggataaaatggccggtcgtcacggtaacaaaggtgttatctctaagattcttcctgaagaggatatgccttaccttcctgacggcacaccaattgatatcatgcttaacccgctgggcgtaccatcacgtatgaacatcgggcaggtattggaacttcacatgggtatggccgctcgttaccttggcattcacattgcatctcctgtatttgacggagcgcgagaagaggatgtctgggaaacacttgaagaagccggcatgtctcgtgacgccaaaacagtgctttacgacggacgtactggagagccgtttgataaccgtgtatctgtcggtatcatgtacatgatcaaactggctcacatggttgacgataaacttcatgcacgctctacaggtccttactcacttgttacgcagcagcctcttggcggtaaagcgcaatttggcggacagcgttttggtgagatggaggtttgggcacttgaagcttacggtgcggcttatactcttcaagaaattctgactgttaagtctgatgacgtggttggacgtgtgaaaacatacgaagccatcgttaaaggcgacaatgttcctgaaccaggtgttccggaatcattcaaagtattaatcaaagaacttcaaagcttaggtatggatgtcaaaatcctttctggtgatgaagaagaaatagaaatgagagatttagaagacgaagaagatgcgaaacaagctgacggcctggcattatcaggtgatgaagagccggaagaaacagcatctgcagacgttgaacgcgatgtagtaacaaaagaataatctctagttataaaggcaagtgacatcggttaatccgaagataaaaagggaggtaggccccttgctagatgtgaacaattttgagtatatgaacatcggtcttgcttcaccagataaaatccgttcatggtcttttggtgaagtgaaaaagcctgaaacgataaactatcgtacgttaaaacctgaaaaggacggtctattctgcgaacgcattttcggaccgactaaggactgggaatgtcattgcgggaagtacaagcgagttcgttataaaggcgtagtttgtgaccgctgcggagtcgaagtaacacgggctaaagtccgtcgtgagagaatggggcacattgaactggctgccccagtttcccacatttggtatttcaaaggtattccaagccgtatgggtcttgtgctggatatgtcacctcgtgctttagaagaagtcatttactttgcttcttacgttgtaactgatccggcgaatacaccgcttgaaaagaaacagcttctgtctgagaaagaatatcgtgcttatcttgataaatacggtaataaattccaagcatctatgggtgctgaagcaattcataaacttcttcaagatattgatcttgtaaaagaagttgatatgttaaaagaagagctgaaaacttcacaaggacaacgccgtactcgtgcgatcaaacgtcttgaagttttagaagccttccgtaactcaggaaacaagccttcttggatgatccttgatgtgcttcctgttattcctccggagcttagaccgatggttcagctagatggcggtcgttttgcgacttctgatttgaatgacctttatcgtcgtgtcatcaaccgtaacaatcgtttgaaacgccttttggaccttggtgcgcctagcatcatcgttcaaaacgaaaagcgtatgcttcaagaggctgtcgatgccctaattgacaacggccgccgcggacgccctgtaacaggtcctggtaacagaccgttaaaatctctttctcacatgctgaaagggaagcaaggccgtttccgtcaaaaccttcttggtaaacgtgttgattactccggacgttctgtaatcgttgttggtcctcatttgaaaatgtaccaatgcggattaccgaaggaaatggcgcttgaacttttcaaacctttcgttatgaaagaacttgttgaaaaaggtcttgctcacaacattaagagtgcgaaacgcaaaattgagcgcgtacagcctgaagtttgggatgtactagaatcagttattaaggagcatccggtactgctgaaccgtgcccctacacttcacagattaggtatccaggcgtttgaaccaacgcttgttgaaggacgcgcaatccgtcttcacccgctcgtatgtacagcttacaacgctgactttgacggtgaccaaatggcggttcacgtaccattatctgctgaagcacaagctgaagcacgcatcttgatgcttgctgctcaaaacatcttgaaccctaaagatggtaaaccggttgtaacaccgtctcaggatatggtactaggtaactattacctgacacttgagcgtgccggtgctgtcggtgaaggtatggtcttcaagaatacagacgaagcgcttcttgcttatcaaaacggatatgttcaccttcatacgagagtagctgttgcagctaactcacttaagaatgtgacatttaccgaagaacagcgctcaaaattgttaattacaactgtcggtaagcttgtcttcaatgaaattcttccggaatcattcccttacatgaatgaaccaacgaagagcaacattgaagagaaaacaccagaccgtttcttcttagaaaaaggtgctgatgttaaagctgttatcgcacagcagccaatcaatgcgccgtttaaaaaaggcattctgggtaaaatcatcgcggaaatctttaaacgattccatattacggaaacgtctaaaatgcttgaccgcatgaaaaacctaggtttcaaatattcaactaaagctggtattacagttggggtttctgacatcgtcgtactcgatgataaacaagaaattcttgaggaagcgcaaagcaaagttgacaacgttatgaagcaattccgccgcggtcttatcactgaagaagaacgctatgagagagtcatctctatctggagtgctgcaaaagacgttatccaaggcaaactgatgaaatcacttgatgaactcaacccgatctacatgatgagtgactctggtgcccgtggtaacgcatctaactttacgcagcttgccggaatgcgcggcctgatggccaacccggctggacgtatcattgagttgccgatcaaatcaagtttccgtgaaggtctgacagtattggagtactttatctccacacacggtgcgcgtaaaggtcttgccgataccgctcttaaaactgctgactcaggttaccttacacgccgtctcgttgacgttgctcaggatgttatcatccgtgaaactgattgcggaactgaccgaggcattcttgctaagcctcttaaagaaggaactgaaacaattgagcgcttagaagaacgcttaatcggacgttttgcaagaaaacaagtgaagcaccctgaaacaggtgaagtgcttgtgaatgaaaacgaactgatcgatgaagataaagcactggagattgtcgaagccggcattgaagaagtgtggatccgttctgccttcacatgtaatacgcctcatggtgtatgtaaacgatgctatggccgaaatcttgcaactggctccgatgttgaagtcggtgaagctgtcggaatcattgctgcccaatcaatcggtgagcctggtacacagttaacaatgcgtacattccatacaggcggggttgccggagatgacatcacacagggtcttccgcgtatccaagagcttttcgaagcgcgtaatccgaaaggtcaggcaacaattacagaaatcgacggtacagtcgttgagatcaatgaagttcgtgataagcaacaggaaattgtggttcaaggcgcagtggaaacacgttcttatacggcaccttacaactcccgcctgaaagtagcggaaggagataaaattactcgaggccaagtactgacagaaggttcaatcgatccgaaagaacttcttaaagtgactgacctgacgactgttcaagagtatcttctccatgaggttcaaaaggtttaccgtatgcagggtgttgaaatcggtgataaacacgtagaagtaatggttcgccagatgcttcgtaaagtacgcgtgattgatgccggtgacactgatgtgcttccaggtacattgcttgatattcaccaatttactgaagcgaacaaaaaggtattgcttgaaggcaatcgacctgctacaggccgtcctgtcttactcggtattacaaaagcatctcttgaaactgattcattcttatctgctgcttccttccaggaaacaacacgtgtccttacagatgcagcgatcaaaggtaagcgtgacgagcttctcggcttgaaagagaatgttatcatcggtaagcttgttccagctggtacaggaatgatgaaataccgtaaagtaaaaccagtatcaaatgttcagccgactgacgatatggtcccggttgaataactgatttaactctgctgaaagactgcaaaaacagtctttcagcagatatatttatgaaaaagtcactctatgagaagaacgaatctaaaaaatgtcataccttgttgacattcgtctcctagaatgataatataaccaaggtgctcgaaataaacctgttactttggaggatatgtttatgtcttatgataaagtatcacaggccaaatcaattattattggtacgaagcaaacagtgaaagctctaaagcgaggttcagtaaaggaagtagtcgttgcaaaagacgcagatccgatactcacgtcaagtgttgtttcacttgctgaagatcaaggtatctctgtctcaatggttgaatccatgaaaaagctcggcaaagcctgcggaattgaggtaggagcagccgctgttgccattattttataacgtacttttgtttttgcgtaagattccatcttgtgtaaagacattgttttttgccttttgatgaaccacctgggtatgtgggttataaaacgtaatgaagggaggaaaaattcatgcctacaattaatcagctaattcgcaaaggacgcgtgagtaaagtagaaaactcaaagtctcctgcacttaacaaaggatacaacagctttaaaaaagagcacactaacgtatcttctccacaaaaacgcggggtatgtactcgtgttggtacaatgacaccgaaaaaaccgaactcagcacttcgtaaatatgctcgtgttcgtttgactaacggaatcgaggttactgcttacattcctggtatcggtcacaacctacaagagcacagtgttgtacttatccgcggcggacgtgtaaaagacttaccaggggtacgttaccacatcgttcgtggtgcgcttgatactgctggagttgaaaaccgtgcacaaggccgttctaaatacggtacgaaaaaacctaaagcaaaataatatacgaaaatacgcataattgatgaagggaggatattcagatgccacgtaaaggtcctgtagcaaaaagagatgttttacctgatccgatttacaactctaagcttgtatctcgtttaatcaacaaaatgatgatcgatggtaaaaaaggtaagtctcaaacaatcctatacaagtcattcgatatcattaaagaacgtactggcaatgatgcaatggaggttttcgaacaagcattgaaaaacatcatgcctgtacttgaagtaaaagcacgccgtgtaggtggtgcgaactaccaagttcctgtagaagttcgtcctgaacgtcgtacgactcttggacttcgctggttagttaactacgctcgtcttcgcggagaaaaaacgatggaagagcgtttagctaacgaaatccttgacgcagctaacaacactggtgctgctgttaagaaacgtgaagacactcataagatggctgaagcaaacaaagcatttgctcactatcgctggtaggatttatagattaacaaaacacaatttcctaataaggaaggagaaattacccaatggcaagagagttctccttagaaaaaactcgtaatatcggtatcatggctcacatcgatgccggtaaaacgactactacagaacgtatcttgttctatactggtcgtatccacaaaattggtgaaactcatgaaggagcttcacaaatggactggatggagcaggaacaagaacgtggtatcacaatcacttccgctgcgacaactgcacagtggaaaggataccgcgtaaacatcatcgatactccaggacacgtagacttcacagttgaagttgaacgttctcttcgtgtacttgatggtgctgttgctgtacttgacgcgcaatcaggcgttgagcctcaaacagaaactgtttggcgtcaggcaacaacttatggagtaccgcgtatcgtttttgttaacaaaatggacaaaatcggtgcagacttcctttactctgtaggaactttaagagaccgtcttcaagcaaacgctcatgcaattcaattgccgatcggtgctgaagataacttcgaaggtatcattgaccttgtagaaaacgttgcgtatttctacgaagatgacctcggaactcgttctgatgcaaaagaaatccctgaagagtacaaagagcaagccgaagagcttcgcaacagccttattgaagctgtatgtgagcttgatgaagagcttatggataagtaccttgagggtgaagaaatcacaattgacgagttaaaagcaggaattcgtaaaggtacattaaatgttgaattctaccctgttcttgttggttctgccttcaaaaacaaaggtgttcaactagtacttgatgctgttcttgactaccttcctgcaccaactgacgttgctgcaatcaaaggtacacgtcctgatacaaatgaagagattgagcgtcattcttctgacgaagagccattctctgcattagcatttaaagttatgactgacccttacgttggtaagttgacgttcttccgtgtgtactctggaacacttgattctggttcatacgtgaaaaactctactaaaggcaaacgtgagcgtgttggacgtattcttcaaatgcacgctaacagccgtgaagaaatctctactgtatacgcaggggatatcgcagctgctgtaggtctaaaagatacaactactggagatactctatgtgatgagaaggatcttgttatccttgagtcaatggaattcccagaaccagttatcgacgttgctattgagcctaaatcaaaagctgaccaagataaaatgggtatcgctttagcgaaacttgctgaagaagatcctacattccgtactcaaacaaacccagaaactggccaaacgatcatctctggtatgggtgaacttcaccttgatatcattgttgaccgtatgaaacgcgaatttaaagtagaagccaatgttggtgctcctcaagttgcgtaccgtgaaacattccgtaccggtgctaaagttgaaggtaaattcgtacgtcagtctggtggacgcggtcagttcggacacgtttggatcgaattcgaaccaaacgaagaaggcgctggctttgaatttgaaaatgcgattgtcggtggggttgttcctcgtgaatacatcccagctgttcaagcaggtctggaagatgcacttgaaaatggtgtactagcaggcttcccgcttatcgacattaaagctaaacttttcgacggttcttaccatgatgttgactcaaacgaaatggcatttaaagttgctgcttctatggcattgaaaaatgcagtcagcaaatgtaacccagttcttcttgaaccaatcatgaaagtagaagtggttattccagaagaatacatgggagatatcatgggtgatattacttcacgtcgcggacgcgtagaaggtatggaagcacgcggtaacgctcaagttgttcgcgctatggttcctcttgctgaaatgttcggttacgctactgcacttcgttctaatacgcaaggtcgcggtacgttcactatgcacatggatcactacgaagaagtgccgaagagcgtcgcagaagaaattatcaaaaaaaataaaggcgaataattgattttgccgcttaactcaagtataactactattgtaagatgaggaagtgaaagctttctttcacttcctatcactctatacattactaattaaaagctcttaaggaggattttagaatggctaaagaaaaattcgaccgttccaaatcacatgccaatattggtacaattggacacgttgaccatggtaaaacaactttaactgctgctatcacaacagtacttcataagaaatctggtaaaggtacagctatggcgtacgatcaaattgatggtgctccagaagaacgcgagcgcggtatcacaatctctactgcacacgttgagtacgaaactgaaactcgtcactatgcacacgttgactgcccaggacacgctgactatgttaaaaacatgatcactggtgctgcgcaaatggacggagctatccttgtagtatctgctgctgatggcccaatgccacaaactcgtgagcacatccttctttctaaaaacgttggtgtaccatacatcgttgtattcttaaacaaatgcgacatggtagacgacgaagagcttcttgaactagttgaaatggaagttcgcgatcttcttagcgaatacgacttccctggtgatgatgtaccagttgttaaaggttctgctcttaaagctcttgaaggagacgctgagtgggaagctaaaatcttcgaacttatggatgcggttgatgagtacatcccaactccagaacgcgacactgaaaaaccattcatgatgccagttgaggacgtattctcaatcactggtcgtggtacagttgctactggccgtgtagaacgcggacaagttaaagtcggtgacgaagttgaaatcatcggtcttcaagaagagaacaagaaaacaactgttacaggtgttgaaatgttccgtaagcttcttgattacgctgaagctggtgacaacattggtgcccttcttcgcggtgtatctcgtgaagaaatccaacgtggtcaagtacttgctaaaccaggtacaatcactccacacagcaaattcaaagctgaagtttacgttctttctaaagaagagggtggacgtcatactccattcttctctaactaccgtcctcagttctacttccgtacaactgacgtaactggtatcatccatcttccagaaggcgtagaaatggttatgcctggagataacactgaaatgaacgttgaacttatttctacaatcgctatcgaagaaggaactcgtttctctattcgtgaaggcggacgtactgttggttcaggcgttgtttctacaatcactgagtaatagtatgattttaaacgagacccctgcgggtctcgttttttgtttgcttatctttttcttgtataataggatctatcatattcgaggggttaatatttatgattcctgaaaagaaatcaatcgcaatcatgaaagaactaagcattggaaatacaaagcaaatgctgatgattaatggagttgacgtggaaaatccattgttgctttttttacatggcgggccgggaacgccgcaaatcggatatgttagacattatcaaaaagagctggaactgtattttacagtagttcattgggatcagagaggatcggggctttcttattctaagcgaatttcgcatcactctatgacaataaatcacttcattaaagatacaatccaagtcactcaatggcttttagctcatttttcaaaatcaaaactttacctagccggtcattcttgggggtcaatactggcgcttcatgttttgcagcagtgtcctgatttattttacgcgtattatggaatcagccaggttgttaaccctcatgatgaagaatcaactgcttatcaacatattcgtgaaatttctgaatcaaaaaatgccagcttattatctttcctcacacgtttcattggtgctccgccttggaagcaggatatccagcaccttatctatcggttttgtgtcgagctaagcaggggaggcttcactcgccgtcatcgtcaatctctagctgtattatttcaaatgcttactggcaatgagtatggagtgcggaacatgcacagcttcctcaatggattgcgcttcagtaaaaaacatttaactggtgagttgtaccggtttaatgcttttacatcagttccttctattaaagtaccgtgtgttttcatttcagggaaacatgacttaattgttcctgctgaaatatcgaaacagtattatcaagagcttgaggcacccgaaaagcgctggtttcaatttgagaactcagctcacaccccgcatattgaggagccggcattattcgcgaacacattaagtcgacatgcacgacaccatttatgatagatccttgataaataagaaaaacccctgtataataaaaaaagtgtgcaaaccatgcatattttaaataagtcttgcaacatgcgcctattttctgtataatggtgtatgttggtctttgactgcgatgaagtgagaggttgctgacacacccggccgctttgccatggcaaggtgttcaggtttttctcacggagaactgtctaacgtgatgtaggcgaaaaggagggaaaataatggcaaaacaaaaaattcgtattcgtttgaaagcatatgatcatagaatccttgatcaatctgcagagaagattgttgaaacggcaaaacgttctggtgccagcgtatctggtccgattccgttgccaactgaaaaatcagtttacacaatccttcgtgcggtgcacaaatacaaagattctcgtgagcaatttgaaatgcgtacacataaacgtttaatcgacattgtgaacccaacaccacaaactgttgatgctcttatgcgattagacttaccatctggtgtcgatatcgaaattaaactttaattctaaaatatagaatgatcttaataggaggtgtgacgaatgaccaaaggaatcttaggaagaaaaattggtatgacgcaagtattcgctgagaatggtgatcttattccggtaactgttatcgaggctgctccaaacgttgttcttcaaaagaaaacagctgaaaacgacggttacgaagcaatccagcttggttttgacgacaagcgtgaaaagctttctaacaaacctgaaaaagggcacgttgcaaaagcggaaactgctcctaagcgcttcgttaaagaattacgcggagtggaaatggatgcgtatgaagttggtcaggaagtcaaggttgaaattttctctgctggagaaatcgtagatgtaacaggagtatctaaaggtaaaggtttccaaggtgcgatcaagcgccacggacaatctcgcggacctatgtctcacggttcacgctaccaccgtcgtcctggttcaatgggacctgtagatcctaaccgtgtattcaaaggtaaattattacctggacgtatgggcggagagcaaatcactgttcaaaaccttgaaatcgtaaaagttgatgcagaacgcaatcttcttttgatcaaaggtaacgtacctggtgcgaagaaatctttaatcactgttaaaagtgctgttaaatctaaataattctcttaggaaaggaggaaattgattatgccaaaagtagcattatacaaccaaaacggttctactgctggtgacatcgaattaaacgcttctgtatttggtatcgaaccaaatgagagtgttgtattcgacgctattcttatgcaaagagcttccttacgtcaaggaactcacaaagtaaaaaatcgttctgaagtacgcggcggaggtcgtaaaccatggcgtcaaaaaggtactggacgtgcccgtcaaggttcaatccgttcaccgcaatggcgcggaggtggtgtcgtattcggcccaacaccacgcagctattcttataaattacctaaaaaagttcgccgcttggcaatcaaatcagtattgtcttctaaagtgatcgacaacaacatcatcgttcttgaagatcttactcttgatacggctaaaacaaaagaaatggcagctatccttaaaggattatctgttgagaaaaaagctttaatcgtaactgcggatgcaaacgaagcagtagctttatctgctcgtaacattcctggagttactgttgttgaagctaacggaatcaacgttttagacgttgtcaaccacgagaagcttctgattacaaaagcagcggttgaaaaagtagaggaggtgcttgcataatgaaagatcctcgtgatgttctaaagcgccccgtcattactgaacgttctgctgatttaatgactgaaaagaaatatacttttgaagttgatgtaagagctaacaaaacagaagtgaaagacgcggttgaaagcatctttggagtgaaagttgacaaagtcaacatcatgaactacaaaggtaaatcaaaacgtgttggacgctacactggtatgactagccgtcgcagaaaagcgatcgtaaaacttactgcagacagcaaagaaatcgaaatttttgaagcttaattatctgtaaaaagaaggagggaaattcaaaatggcgattaaaaagtataaaccgacctctaatggacgtcgtggcatgacaacttcagattttgctgaaatcacgactgacaagccggaaaaatccttgcttgctccccttcacaaaaaaggcggacgtaacaaccaaggtaaattgactgtacgtcaccaaggtggcggacataaacgccaataccgtgttatcgacttcaaacgcgataaagatggtatacctggacgcgttgctacagttgaatacgatccaaaccgttcagctaacatcgctctaatcaactatgcagacggagaaaaacgttacattcttgctcctaaaggaattcaagtaggtactgaaatcatgtcaggtcctgaagctgacattaaagtaggtaatgcacttccacttatcaacatccctgttggtacagttgtgcataacattgaattaaaacctggtaaaggcggacagcttgtacgttcagctggtacatctgctcaggttcttggtaaagaaggtaaatacgttcttgtacgtcttaactctggtgaagttcgcatgatcctttctgcttgccgtgcttctatcggtcaagtaggtaacgaacagcacgaacttatcaacattggtaaagctggacgttctcgctggaaaggcatccgtcctacagttcgtggttctgtaatgaaccctaacgatcacccacacggtggtggtgaaggacgtgcgccaatcggacgtaaatcaccaatgtctccatggggcaaacctactcttggattcaagactcgtaagaaaaagaacaaatccgataaatttatcgtacgtcgtcgtaaaaataaataacggggttgtctacggttcttttcggaccgtagtgcaatcacgaagggaggttccaaaatggctcgcagcttaaaaaaaggaccatttgtcgatggacacttgatgactaaaatcgagaaattaaatgaaacagacaagaaacaagtcgtaaaaacttggtctcgtcgttctactattttcccacagtttattggtcacacaatcgcagtctatgacggacgtaaacacgtgcctgtattcatctctgaagatatggtagggcacaagttgggtgaattcgctccaactcgtacgtacaaaggtcatgctagtgatgacaaaaaaacaagacgctaagagaggaggcttttaaatgcaagctaaagctgttgcaagaacagtccgtattgctcctcgtaaagcacgtctagtaatggacctgattcgaggcaagcaagtaggtgaggcagtatcaatcttgaaccttacaccaagagctgcttctccaattatcgagaaagtattaaaatccgctattgcaaatgctgagcataactatgaaatggacgctaacaacctggttatttctcaagcattcgttgacgaaggccctacgttaaaaagattccgcccacgtgctatgggacgtgcgagccaaatcaacaaacgtacgagccacattacaatcgttgtatcagaaaagaaggagggataagtagtgggtcaaaaggtaaatccagtcggtcttcgtatcggagtcattcgtgattgggaatctaagtggtacgctggtaaagattacgctgacttcctgcacgaagatttaaaaattcgtgaatacattagcaaacgcctttctgacgcttctgtttctaaagtagaaatcgagcgtgcagcaaaccgcgttaacattacgatccacacagctaagcctggtatggttatcggtaaaggcggttctgaagtcgaagcacttcgcaaagcccttaacagccttactggcaagcgtgtacacattaacattcttgaaatcaaaagagcagatcttgatgcacagctagttgctgacaacatcgctcgtcaattagaaaaccgtgtttctttccgccgtgcgcagaaacaacaaatccaacgtactatgcgtgctggagcacaaggtgtgaaaacaatggtttctggtcgtcttggcggtgcagatatcgctcgttctgaatactacagtgaaggaactgttccattgcacacattacgtgcggacattgactatgcaacatctgaagctgatactacttacggtaagcttggtgtaaaagtctggatctatcgtggagaggttcttcctactaagaagaaaactgaggaaggaggaaaataatatgttattaccaaaacgcgttaaatatcgcagagagcatcgcggaaaaatgcgtggccgtgcgaaaggcggtactgaagtacatttcggagaattcggtatccaagctcttgaagcttcttggattactaaccgtcaaatcgaagctgcacgtattgcgatgactcgttacatgaaacgtggcggtaaagtttggatcaaaattttcccttctaaaccttacactgctaaaccacttgaggtacgtatgggatccggtaaaggggctccagaaggttgggtagctgttgtaaaaccgggcaaagttttatttgaaatttctggtgtgtctgaagaggttgctcgtgaagcgcttcgccttgcatctcacaaattgccaattaaaacgaagttcgtaaaacgtgaagaaattggtggtgaatcaaatgaaagctaatgaaattcgtgaccttaccactgctgaaattgaacaaaaagtaaagtctcttaaagaagaacttttcaatcttcgctttcaattagcgacaggacaacttgaaaatactgctcgcattcgtgaagtgcgcaaagctatcgcgcgcatgaaaactgtgattcgtgaaagagaaattgctgctaataaataatcactgaggggaggtcgtgagcatgagcgaacgtaaccaacgcaaagtttaccaaggccgtgttgtttctgacaaaatggataaaaccattactgttgttgttgagacatacaaaaaacatacactttacggtaaacgcgtaaaatactcaaaaaaattcaaagcacatgatgaaaataatcaagctaaaatcggtgacatcgttaagatcatggaaactcgtccattgtctgcaactaagcgtttccgtctagttgaagttgtcgaagaagctgttattatctaataaagttcggaattctttttccgaagggaggtaacaaataatgattcaacaagagactcgtttaaaagtagctgacaactctggcgcacgtgaagtacttactattaaagttcttggtggttctggacgtaaaacagctaacattggtgatgtaattgtttgcacggttaaacaagcaacaccaggaggcgttgtcaaaaaaggtgaagtcgtaaaagctgttatcgttcgcactaaaagcggagcgcgcagaagtgacggttcatacatcagcttcgatgagaatgcatgtgttatcatccgtgacgacaagagcccacgcggaactcgtatcttcggaccagttgctcgtgaattgcgtgaaaacaactttatgaaaattgtttctctagctccagaagttatctaatgaaataaatgccttactcaaggaggtgcgatcaggatgcatgtaaaaaaaggcgataaagttatggttatctctggtaaagataaaggcaaacaaggaacaatccttgctgctttccctaaaaaggaccgcgttttagttgaaggtgttaacatggtaaagaaacactctaaaccaactcaagctaaccctcaaggcggtatttctaatcaagaggcgccaattcatgtatcaaacgttatgccgctcgatcctaaaacaggtgaagtgactcgcgtaggatacaaagtggaagatggcaaaaaagttcgtgtagcaaaaaaatctgggcaagttctagataaatagtattaaaaggaagggaggtctatctcatgaaccgccttaaagaaaagtacaataaagaaattgcacctgctttaatgactaagttcaattatgattcagtcatgcaagtgcctaaaatcgaaaaaatcgtaatcaacatgggtgttggtgacgctgttcaaaacgccaaagcaatcgacagtgctgttgaagaattaacgtttatcgcaggtcaaaaacctgtcgttactcgtgcgaagaaatcaattgctggattccgtcttcgtgagggaatgcctatcggtgcgaaagtaactcttcgcggagagcgcatgtatgatttccttgataaacttatttctgtatctttaccgcgtgtacgtgacttccgcggggtttctaaaaaatctttcgacggtcgcggtaactacacacttggtatcaaagaacagttaatcttccctgaaattgactacgataaagtaacaaaggttcgcggaatggacatcgttatcgtaacaactgctaatactgacgaagaagctcgtgagctattaactcaagtaggtatgccgttccagaaataatcaatgaaagggaggcgaaatcgtggctaaaaagtctatgattgcgaaacaacaacgtacaccaaagtttaaagtacaagagtacacacgctgtgaacgctgcggacgtccgcattcagtcattcgtaaatttaaactttgccgtatttgtttccgtgagcttgcatataaaggacaaattcctggcgtgaaaaaagccagctggtaatccccaagaaagggaaggaggtaattatataatggttatgacagatccaattgcagatatgctaactcgtattcgcaatgcaaacatggtacgtcatgagaagcttgaaattcctgcttctaaattgaaaagagaaattgctgaaattttaaagcgtgaaggtttcattcgtgacgttgagttcgtagaagacagcaaacaaggtatcatccgcgttttcttgaaatacggacaaaacaacgagcgcgttatcactggtcttaaaagaatcagcaagcctggtttgcgtgtttatgctaaatctaatgaagtaccccgcgtacttaacggtcttggaatcgcgattatttctacatcacaaggtgttttaacggacaaagaagcccgtgcaaaacaagctggtggagaagttctagcatacgtttggtaagaagtttaacatgaatggaggtgtttggtatgtctcgtgtaggtaagaagctacttgagattccttctgatgttacagtaacgttaaatgataacaacactgtagctgtgaaaggaccaaaaggagaattaactcgtacgtttcaccctgatatggagattaaagtagaggacaatgtgcttacagtcgctcgtccttctgatcaaaaagagcaccgtgccctgcatggtacgactcgcagtctgcttggcaacatggttgaaggtgtatctaaaggatttgaaagaggtttggaattagtcggtgtcggttaccgtgcttctaaatccggaaataaacttgttttaaacgttggatactctcatcctgttgagatcgttcctgaagaaggcatcgaaatcgaagttccttctcaaacaaaagtagttgtaaaaggtacagacaaagaacgcgtaggagctattgctgctaacatccgcgctgtacgttctccagagccttacaaaggtaaaggaatccgctacgaaggtgaagttgttcgccgtaaagaaggtaaatctgctaagtaagatcgcttaaagtgaagaaaggagtgacctagatgattacgaaaactagcaaaaatgctgctcgtcttaaaagacacgctcgtgttcgcgctaaactttccggtactgctgaaagaccgcgcctgaacgttttccgttctaacaagcacatttacgctcaaatcatcgatgatgtaaatggtgtaacacttgctagtgcatctactctcgataaagacttgaacgttgaaagcactggagatacttctgctgctactaaagttggagaattagttgcaaaacgcgctgctgaaaaaggcatttctgacgtagtatttgaccgtggcggatacttataccatggacgtgtaaaagctttggctgatgccgctcgtgaagctggacttaaattttaataaaagaaggagggacacatgattatgcgtcgtattgacccaagcaaattagagttagaagaacgcttagttacggttaaccgcgtagcgaaagttgttaaaggtggtcgtcgtttccgcttcgcagctctagtcgttgtcggtgacaaaaacggacacgtaggattcggtactggtaaagcacaagaagtaccagaagcgatccgcaaagctgttgaagatgcgaaaaagaatttgattgaagtaccaatggttggaactacaattccacacgaaatcatcggacgtttcggtgcaggtaacatcttgttaaaacctgcttctgaaggtactggagttatcgctggaggccctgtacgtgcggtacttgagctagctggtgtagctgatatcctttctaagtctttaggttctaacacaccgatcaacatgattcgtgcaacacttcaaggtttaagtgagcttaaacgtgctgaagacgttgcgaagcttcgtggaaaatctgtagaagaactgttaggataaggagggaacattaatggctaaattagaaattaccctcaaacgaagtgtaatcggtcgcccggaagaccaacgcgttactgtaagaacacttggtttaaagaaaacaaaccaaactgttgttcatgaagacaacgctgcgatccgtggtatgattaataaagtatctcatttagtttctgttaaagaacaataaaaatatttgatcggataaggaggtgtcctaatgaaacttcatgaattaaaaccttcagaaggttcacgtaaaacgcgtaatcgcgtaggtcgtggtattggttctggcaacggtaaaacagctggtaaaggtcacaaaggtcaaaacgctcgttctggcggcggtgtacgccctggattcgaggggggacaaatgcctttattccaacgtcttcctaaacgcggtttcactaacatcaaccgcaaggaatacgctgtagtcaacctagacaaattgaacggttttgcagaaggaacggaagtcactcctgaacttcttctagagactggtgttattagcaaacttaatgcaggagtaaagattcttggcaacggtaaattagagaaaaaattaactgtaaaagccaataaattctctgcttctgcgaaagaagctgttgaagctgctggcggtacagctgaggtgatctaacttgtttaaaacaatctccaactttatgcgtgtgagtgatatcaggaataaaatcatattcactttactcatgcttatcgtctttcgcataggtgcgtttattcctgtgccttacgttaacgctgaagcgttacaggcacagtctcaaatgggtgtttttgatctccttaatacatttggcggcggtgcgctttaccaattttccattttcgcaatgggaattactccttatatcacggcttcgatcatcattcagctgcttcagatggatgtggtaccgaagtttaccgagtggtctaagcaaggtgaagttggccgccgtaaattagctcagttcacaaggtactttacgattgtgcttggtttcatccaagcgttaggtatgtcatatggattcaacaatctggcaaacggtatgctgatcgaaaaatccggtgtatcgacatatcttatcattgctttagtgctcactggcggaactgcctttttaatgtggcttggggaacaaattacttctcatggagtaggcaacggaatatcgatcattatcttcgcggggattgtgtctagtattccaaaaacaattgggcaaatatatgagactcaatttgtcggcagcaacgatcagttgtttattcatattgtgaaagtcgcacttcttgtgattgcgattttagcagttattgttggagttattttcattcagcaagccgtacggaaaattgcgattcaatatgctaaaggcacaggtcgttcacctgctggcggaggtcagtctacacaccttccattgaaagtgaatcctgcaggggttattccggtaatctttgcggttgcgtttttgataacgccgcggacgatcgcgtcattctttggaacaaacgatgtgacaaagtggattcaaaacaactttgataatacgcatccggtgggtatggcgatatatgttgcgttgattattgcctttacgtacttttatgcttttgtacaggtaaaccctgaacaaatggctgataaccttaaaaaacagggtggctatatcccgggggttcgtccagggaaaatgactcaagatagaattacgagcattttgtatcgacttacgtttgtgggttctatattcttagccgtgatttccattcttcctatctttttcattcaattcgctggattgcctcaaagtgcacaaattggcggaacatctttgttaattgttgtcggggtagccttggagacaatgaaacaactagaaagccagttggtgaaacgaaactaccgtggatttatgaaaaactagaggaaatggatttatccattccctcttaataaagagaggacgggggaaatccgaatgaacttagtcttaatggggcttcctggtgccggtaaaggcacacagggcgaacgaattgttgaggattatgggattcctcatatctcaacaggagatatgttccgtgctgctatgaaagaagaaacaccactcggactcgaagcaaaatcttatattgataagggagagctcgtacctgacgaagtcacaatcggaattgtaaaagagagacttggcaaagatgattgtgaaagaggttttcttctggacggatttccgcgaacagtcgctcaagccgaagctcttgaagaaattcttgaggaatacggcaagccgattgattatgtcattaacattgaagtcgacaaagatgttctgatggaacgtctgactggacgcagaatttgcagtgtttgcggcacaacctatcatttagtctttaatccgccgaaaacgccgggtatttgtgataaagacggaggcgaactctatcaacgggcagatgataatgaggaaacagtctctaaacggcttgaggtaaacatgaagcaaactcagcctttactcgatttctattcagagaaaggttatcttgcaaacgtgaatggccagcaggacattcaagacgtttatgcagatgtgaaggatcttcttggaggattaaaaaaatgattatctgtaaaaccccacgtgaacttggtatcatgcgggaagcagggcgaatcgtggctttaactcatgaagagttaaaaaagcacattaaaccaggaatctcgacaaaagaattggatcaaattgccgaacgttttattaagaagcagggtgcaatcccatcttttaaggggtataatgggtttcgcgggagcatttgcgtatcagttaatgaagaactcgttcacggcatacctggcagcagggtgctgaaggacggtgacatcatcagtattgatatcggtgctaaattaaatggttatcatggtgactctgcatggacatatccggtaggaaacatcagcgatgatgacaaaaaacttctggaagtgacagaggagtctttatataaaggcttgcaggaagcaaaaccaggtgaacgtttgtcgaatatttcccacgcaatacaaacgtatgtcgaaaatgagcagttttcagttgttagggagtatgtcggacatggtgttggtcaagacttgcatgaggacccgcaaattcctcattacggtccgcccaacaaaggaccacggcttaaacctggcatggttctcgctattgaacctatggtgaacgctggcagccgctacgtgaaaacattggctgataactggacggttgtaacggtagatgggaaaaagtgtgctcattttgaacatacgattgcgattacggaaacgggttttgatatactgacgagagtctagatgatgaaaataattccgaagacagatgtttttcaagcttgatagggcagaaagcttgggtgaacattggcaagaccgaattcatcttgctgcttgtcgttggaattttaaccatcatcaatgtactaacagcagacggagaaaagcgtacatttcattctcctaagaaaaagaatatcaatcatttaaccctttatgattgcgtatctccggaagttcagaacagtataaacgaaacagggcgtgtgacaaacttcttttgaaatttgtcagaaagcaagttactgatttgaagaagggagaacacttgaatggcgaaagacgatgtaattgaagtggaaggtactatagtcgaaacactgccaaacgcgatgttcaaagttgaacttgaaaatggccacactgttttggctcatgtatctggtaaaatccgcatgcacttcattcgcattttacctggagacaaagttacggtagaattatctccatatgacttaactcgtggcaggattacgtaccgttacaaataaagcactccggaaactgaaggaggttggaaacacatgaaagtgagaccatcagttaaaccaatctgcgaaaaatgtaaagttattcgcagaaaaggaaaagtaatggtgatctgtgaaaatccaaagcataaacaaaaacaaggataatttataaggaggtgcccagagaatggctcgtattgctggtgtagatatcccacgtgacaaacgtgttgttatttctttaacatacatcttcggaattggccgcacaacggctcagcaagttttaaaagaagctggagtttcagaagatactcgtgtgcgcgatcttactgaagaagaacttggtaaaatccgtgatattattgacaaactgaaagtagaaggtgaccttcgccgtgaagtttctcttaatatcaaacgtctgatcgaaatcggaagctaccgcggaatccgtcatcgcagaggattacctgttcgcggacaaaactctaaaaacaacgcgcgtactcgtaaaggtccgcgtcgtactgtagctaacaagaaaaaataagtaagggaggttcttaaacaatggctgctgctcgtaaatctaacacgcgtaaacgtcgcgtgaaaaagaatattgagtctggaattgctcatattcgttcaactttcaataacacgatcgttacgatcactgacactcatggtaatgctatttcttggtctagtgccggagctttaggattcagaggttctcgtaaatctactccttttgctgcgcaaatggctgcagaaacagctgctaaaggttcaatcgaacatggtcttaaaactctagaggttactgttaaaggacctggttcaggccgtgaagctgcaatccgtgcacttcaagctgctggactagaagtcactgctatcagagacgtaactcctgttcctcataacggatgccgtccaccaaaacgtcgccgcgtgtaatttgtttgtatagattttgtgtccctgtcaataatgggttatgatacagttatttatgaaacgaatgcaccgactcgttgcctgagcacatacgggactaaacaatggggaatttcggatggaatctcatatgattctattcgaggtttcgacgttttgaaggagggttttaagtaatgatcgagattgaaaaaccaaaaatcgaaacggttgaaatcagcgacgatgccaaatttggtaagtttgtcgtagagccacttgagcgtggatatggtacaactctgggtaactccttacgtcgtatcctcttatcctcactccctggtgccgctgtaacatcaatccagatagatggtgtactgcacgaattctcgacaattgaaggcgttgtggaagatgttacaacgattatcttacacattaaaaagcttgcattgaaaatctactctgatgaagagaagacgctagaaattgatgtacagggtgaaggaactgtaacggcagctgatattacacacgatagtgatgtagagatcttaaatcctgatcttcatatcgcgactcttggtgagaatgcgagtttccgagttcgccttactgctcaaagaggacgtgggtatacgcctgctgacgcaaacaagagagacgatcagccaatcggcgtgattccgatcgattctatctatacgccagtttctcgtgtatcttatcaggtagagaacactcgtgtaggccaagttgcaaactatgataaacttacacttgatgtttggactgatggaagcactggaccgaaagaagcaattgcgcttggttcaaagattttaactgaacaccttaatatattcgttggtttaactgacgaagctcaacatgctgaaatcatggttgaaaaagaagaagatcaaaaagagaaagttcttgaaatgacaattgaagaattggatctttctgttcgttcttacaactgcttaaagcgtgcgggtattaacacggttcaagagcttgcgaacaagacggaagaagatatgatgaaagttcgaaatctaggacgcaaatcacttgaagaagtgaaagcgaaactagaagaacttggactcggacttcgcaaagacgattgactagtttcccttgtgaactaggattttcgtgtgtttattattcagaaacagcattccaataaaggaggggacatcacatgtcatacagaaaactaggacgtacgagtgcacagcgtaaagctatgcttcgtgatcttacaactgatttgatcatcaacgaaagaatcgaaacaactgaaacacgtgcgaaagaacttcgctctgtagttgaaaaaatgatcacgcttggcaaacgcggtgatcttcacgctcgccgtcaagctgctgcatacatccgcaacgaggttgcaaacgaagaaaataaccaagatgcacttcaaaaattattctctgacattgcaactcgttacgaggagcgccaaggcggatacacacgtattatgaagcttggtcctcgccgtggtgacggagcaccaatggcaattatcgaattggtttaatcacatatttttgtgtatctaaagaagggcgggacagtttctaactggatctatgccctttttttagatactgcaacttttaatagagagaaaagcagagcattagctgagaggaggccggttttccatgaatcaaaatcagttgatatcggtagaggatatcgtatttcgatatcggaaggacgcagaaagacgagcactagacggcgtctccctgcaggtgtatgagggtgaatggcttgcaatcgtaggtcataacggttcagggaaatcaacactggcccgggcattgaatggtttaattcttcctgaatcaggcgacattgaggttgccgggattcaattgacagaggaatctgtttgggaagtgcgtaagaagataggtatggtctttcaaaatccggataaccaatttgtcggaacgactgttcgcgatgatgtggcttttggtttagaaaacaatggtgtaccgcgggaagaaatgattgagagagtagactgggcagtaaaacaggtgaatatgcaagattttctcgatcaagagccgcaccatctctccggaggccaaaagcagagagttgcgattgcgggggttattgccgcacgtcctgatattattatcttagatgaagcaacatccatgcttgatccgatcgggcgagaagaagtgcttgaaacggtaagacatttaaaagagcagggcatggcgactgtcatatccattacacatgatctgaatgaggcagcaaaagcagacaggatcattgtcatgaatggcggtaaaaaatatgctgaagggccgcctgaagagatttttaaattgaataaagaacttgttcgaattgggcttgatttacccttctcattccagcttagccagcttttaagagaaaatggactggctttggaagaaaaccatttgactcaggaagggctggtgaaagagctgtggacattacaatcaaagatgtagagcatcgctatcagatgaagacgccgtttgagcgcctagcactgtatgatatcaatgcatcgattaaagaaggaagctacgtagccgttatcgggcatacaggctctggcaagtccactcttcttcagcacctaaatggtctcctgaagccgacgaagggacagatatcactaggcagcactgtcattcaggcagggaaaaagaataaagatctgaaaaaacttcgtaaaaaagtcggaatcgttttccaatttcctgagcatcaattattcgaagaaacagttcttaaagatatttcattcggaccgatgaactttggtgttaaaaaagaagatgctgaacaaaaagcgagagagatgctgcagcttgtaggtttatcagaagagcttttggacaggtcaccctttgaattaagcgggggacaaatgcgcagagttgcaattgccggcgtacttgcaatggaccctgaagtgcttgttctcgatgaaccgactgcaggattggacccaagagggcgaaaagagattatggacatgttttatgagcttcatcaacgtgggaacctgacgacgatccttgtgacacacagcatggaggatgcagctgcatacgctgatgaaatgattgttatgcataaaggaatgatacaagcatcaggcagtccgcgtgatctgtttttaaagggtgaagagatggccggctgggggctggatcttcctgaaacaataaaattccaaagacaccttgaagctgtactgggtgtgagatttaatgagcctatgctcacaatcgaagatgccgctgccaaaatccgtgctctttttcagggggagaagactttatgatggacagcatgattatcggcaagtatgtaccgggtacttcacttgtgcaccggcttgaccccagaacaaaactgatcacgatctttttatttgtctgcatcgtattcttagccaataatgttcagacatatgcgttgcttggtttatttacaattggcgtcgtttctttaacaagagttcctttctcttttttaatgaaagggctgaagccaatcatctggattgtcctttttacgttccttcttcacatccttatgacacatgaaggaccgattatctttcaaataggttttttcaaagtctatgagggcggtctggttcaggggatattcatttctcttagattcgtctatttgattttaatcacaaccttattaacgcttacgaccacaccgattgagattaccgatggaatggaacagctgctgaacccattgaaaaaattaaagcttcctgttcatgagctggctcttatgatgtcaatttctttacggtttattccgacactgatggaggagacagataagatcatgaaggctcagatggcgcgaggcgttgattttacaagcgggcctgtcaaagatagagtgaaggctattgtcccgcttcttgtcccgctcttcgtcagcgcatttaaacgcgccgaagagcttgcggtggcaatggaagcaagaggctatcaaggcggagaaggacgtacgaaatatagaaagcttgtatggacaggaaaagacacttctgtcattgtcagcttaattgtattagctgctttgttatttttcttaagggcttagaggtgctgtatgagactgaaatgcacgatttcttatgacggacatttgtttaacggttatcaggttcagccgggcaaaagaacggttcaggatgaactggagaaggctttggctgtcctgcataagtcaaaagacagaattccggttgtttcgtctggaagaacagacagcggggttcacgcagccggacaggtgattcattttgacactccgctgtctatcccggctgagagatggccatatgccttaaatgcactgcttccggacgatatcgcagtcaaacaggcagaaattgcggatgatgggttccatgcacgatttagcgcagtcaaaaaagaatatcgctactttgtatacacggagaaacacccggacgtatttaaacggcattacgcttaccatttttcatatcgccttaatgtgcaggacatgagagaagcggcaaagcatcttatagggacacatgattttacgagcttttgcgcggctaaaacagaagtgcaggacaaggtaagaacgatatacgaacttgattggactgagacggctgacggcctgcaaatgcggatcacaggcagcggtttcttatataatatggtcagaattattgcgggtactttgcttgatgcaggtattggaaaaatttctcccgatgaggtgaaatccatgctggaagcgaaggatcgcgaagcggcagggcgcacagcgccggggcacgggctatatttatggaacgtttactatgacaactaaaccaggtgtataatattttcttgacagagtctgcataaagttataagatatcatatggtatgtatttcaaccccacgataagccccggaacttattgtgttgtgaaatagaacgtaatcgaagtttattgaaaatgacagatcatttaggagggaaattcaatgcgtacaacacctatggctaacgcaagtactattgaacgcaagtggttagttgttgatgctgctggcaagactttaggtcgtctttcttcagaagttgcagctatccttcgcggaaaacacaaaccaacttacacaccacacgttgatactggagatcatgtgatcatcatcaacgctgaaaaaatcgagttaactggtaaaaagttaactgacaaaatctactaccgtcacactcaacatccaggcggattaaaatcaagaactgctcttgaaatgcgtacaaactaccctgagaaaatgcttgagcttgctatcaaaggcatgcttccaaaaggttctctaggtcgtcaaatgttcaaaaaattgaacgtataccgtggttctgagcatccacacgaagcacaaaaacctgaagtttacgaacttcgcggttaattaaaaaggaggttaccaatttggcacaggttcaatattacggtactggccgtcgtaaaagctctgtagcgcgtgtgcgtttagttccaggagaaggccgtatcgtcgttaataatcgtgaaatcagcgaacatatcccatctgcagctttaatcgaagatatcaaacaaccattaactttgactgaaacagctggcacttatgatgttttagtaaacgtacatggaggcggcctatctggtcaagctggagcaatccgtcacggtatcgctcgtgctttgcttgaagcagatccagaataccgtacaactcttaaacgtgcaggtcttctgactcgtgacgctcgtatgaaagaacgtaaaaaatacggtcttaaaggcgctcgtcgtgcacctcagttctcaaaacgttaattttacgttttcaaaaagctctcgaccttgggttgggagcttttttctttcaataaaacgtggcagcctcgcataaaaataacaactgaatggacgtttggcggggttaagcaaattgtttgtttataaacggtctctttgtaataatcatgttagctttcattcttattcaattggaacttcggtcaatgtttattatcgttatgtgctcagcccagcttcatctaaccactgtatctcatccgttaaagttcactgctgattcttaacccggagaaacaatagctctcattgctaatggctttatgtaacgaagtaaaagtaaatctgatgatataaatcacatatctcctttgtgatttttttgcgtttttatgaacttttttctaaatatgcaaagggaaagcgatatcaatctagaaatatttgttatactctatacattaaagtaaggagaagattcatgaatgcgttagtagctcataatagcaaagcctgggataaaaaagtagaaacaggcaatgaatggactgttgctgttgagcagcaggttatcgaacaagcaaaaaaaggcaattgggatataagggtaacaccaatgaaagatgtaccgaaggattggtttccgcctatcaaaggtctgaaagtactctgtttagcatcaggcggcggccagcagggtccagttttggcagccgcaggcgcggatgtcaccgtattagataactcagaaaaacaactgaatcaggataaaatgattgctgagcgagatggtctcacgatacacactgtcaaaggaagcatggacgatttaagtgtatttaatgatgaatcatttgatgtcattgtacatcctgttgccaatgtttttgttgagaatgtcctcccggtatggaaggaagcgtaccgtgtgttgaaaaggaacggcattctaatctcgggttttgtcaatcctgttgtatttctgtttgatacagaattagaacagcaaggtgttttaaaagtaaaacactccattccatacgctgacccagaagatcttccgaaacataaagtgaaaaaactgatcgaaaataatgaggctctggaattcggtcattccttagaagaccaaatcaaaggccagattgatgccggttttatcgttactggtttttatgaagataaaggcgggtttgtattagaccaatatatccatacatattctgcaacaagaagcgtgaaagtatgaaaagcagcgacctgttagaggggctgcttttttcataaccaattacagaacgtttgttccgcaccctgcggaaagctgattttttatcgattttacaccttcatttgggcgaatttccaaccgaattcgggcattgtttcatcatccaaacctcaaaataatcggtaaaaggagagtgaatttatatggcagaagtactgtcttttatggatgtgaaacgccaaaaggattttgaattagaaaagaacttgctcaaagaactctctctgagacaaattatccagtctgttaaggattgtttggaaccattatttccatttttacatgatgaacgagatattattactgaaggctgtattgattttgcgattgaagcttatttgttaggcgggcgttttgggatattcggctattacggagaatccatgcagagtatcagtgcccgctctgcaagagaagaagaagagctacgtatggagttttttgattatctctataattggatacacgagcaatacgcaacatttgataaaaacacggtttatgaagcggcacgcaagttcattaaagattggtggacagcggggtttgttcaaagagaaaaacagtgtaagcttcgcatgcgataatcatatttcccggccctgtcccatagttatgtaataacggacaagcgggaggggaagggatgaggaaaaagcttaaatggctcagttttttgctaggcttcatcgtattactatttctgttcaaatatcagttcagcaataacgactcttggaagccgtggagcttgcccttgagcggtaaaatcatttatctagatccaggtcatggcgggcctgacggcggagcagtcggcggaaagctgttagagaaggatgttaccctggaagtggcctttagagtcagggattatcttcaagaacaaggagcgcttgttatcatgaccagagaaagtgatactgatctcgctccagaaggaacaaaaggctatagtcgacgaaaagctgaggatctaagacaacgagtcaaattaataaaccattcagaggcggagctctatatcagcattcatcttaatgcgattccgtcacaaaaatggagcggagcccaaagcttttattacgggaaatatgcggaaaatgagaaagtcgcaaaatacatccaggatgagctgagaagaaatctggaaaacacaacccggaaagcaaagcggattcatggtatctacttaatgcaaaacgtcaccaaaccgggggcgcttatagaagtcggatttttatccaatccaaacgaagcaacgctactcggtaaaccgaaatatcacgacaaggtggcatcttccatatataaaggcattttgcgatatttcacagaaaaaggagaccctccggagtaatggagggttttcttgtggttctaagcataagacacccgccatttatgtatgatataataataattgtaaacgaatacacaaaagggtgaggttcgatgataagagaagatgaagtaagaaaactagtcggagaaatgcgcgaaccttttcttcaaagacctctgggagaattggatgccgttaaggaaattaaaataaagcctgaaaaacggcatatcagtgtaaaagtcgctcttgcaaaaacaggaactgcagaacaaatgcagattcagcaagagatcgtaaacgtattaaaaggggcaggagctgagacagtcggccttcgatttgaagagctgcctgaagaaacggttgctaaattccgggcgccgtcagctgagaaaaaaacattattaaatatggataacccgccagtctttcttgctgtagcaagtggaaaaggcggcgtaggcaagtcaactgtgtcagtaaacctagctatttctctggctcgtctagggaaaaaggttggtttaattgatgcggatatttatgggttcagtgtgccggacatgatgggtatcactgtgcgtccaacaattgaaggagagaaacttcttcctgttgaacgctttggagtaaaggtcatgtcaatgggctttttcgtagaagaaaatgccccggtcgtatggagagggcccatgctcggcaaaatgctgaataattttttccatgaagtagagtggggagaagtagactatatcgttcttgatcttccgcctggtacaggggacgttgctctcgatgtacatacaatgcttccgagctgcaaagaaattatcgtatctacgccacatccgacagctgcttttgtcgcggccagagcgggctctatggcgattaaaaccgatcatgaggtcgtgggtgtcatagagaacatggcttattatgaaagtgcaaagacaggggaaagagaatatgtgtttggaaaaggcggaggagataaactggctgaggaactaaacgtgcctttgctcggcagaatcccattgaaacagcccgattgggataaggaccaatttgctccgtctgtttatgacgaaaatcatccaatcggagaaatatatcaggacatcgcaaaaaaaatagatgcaaaaatgtcagtgcaggtataaaaggtgaaccgggattccagatcccggctttccctttattcactttcttttgctgtgtcttttgctgcttttttcagctcatcttcgaactgctttttgtaaagcggactagaaagtgtttcgttaataacctcttctaaataactgcggaattcttggctttttgccagctggctgtactttttatccatgccgggatcctgcataacgctcatcagcatcttctggtaatctggatccttcatcagctttttaatcactttttcatgctctgtctgaagagttttggcaaagccctcagcaaaatcagtgtcttcaaagatgtttttccaaaattcttcaccttttttagatgtgagtgttttttctattgttcctttaattgcatcttggtcaatcaccagcgcttcattcatggcatcatcatttaataattccttaatagctttctttccatcatcagtttttaatatatcaacaaccatttttttggtctgatcatagtccatatccgttgcttggtcttttggagcgcaagctgttacagataataacaaaaaacagctcatcaatagcgttttggcttttgacatgcttaagctcctttcacatacttgtcttacctttaatatgattcatctgtttggaattatacataacaaaatatcgctgttcgcgatttttgaggggatgaataaagaaatgaaaagccgtggtttagttcgttttttcttttctattttagctgtcggggcgcttatcacgagtattgtgggttttgctttaaagtggggagaatatagagggctgtttctaacatttgaagcgggacagattttctctgttttattttggtttatcggtgtaggcatgattttcagtgtgatcagccaaatgggttttttcgtgtttttaacagttcatcggtttgcgcttgagatattaaggtcctcctctttgtggaatttgctgcagttgtttttcatcctgtttgttgcttttgatttaatgtacgtgcgttttttattttttggagagagcggagaatcgctggctggctatgcgtggttaccggtgtttttattgatctttggagtgattacagcttatataaagcaaaagcagtcctctaagaaaacatttgtgtcatcgttatttttgatggttgtgattaccgcattagaatggttccctgcattaagagtaaatgatgaggactggctttatttaatgctttttccgttaatggcatgtaatgccttccaattgctgatgctgccgaagtttgcagcaaagtaattactttacctctgcggatttggcatcagaatttgcgatgagatcacccacggttacattttttaatcctttttctttcagctgatggatgatatcaggcaatgcttcttctgtttgttttgcagaatcggaggcatgtaaaagaataatgtctccaccggaaacttgcttggtcacattgtcgatgattttttcaactccgggatttgtccagtcttgagagttcacactgtaatgaacgactgtataattgtattgctttgcgacctttagaacattcttattgaattggccggtagggggtcttaatagctgtatgtctttgacccctaacttttcaaaggctgtttgcgcacggttcatgtccttttttatttcgctgctctctaaattggcatagtttttataagcgtagcccatgctcccgatttgatggccgtcctttacgatacgggccactgtgtcgggatggcgttctgcccaagaagcggacaggaaaaacgttgcgtttttaatcccgtttgctttcagagtattaagtatcggttctgctctctcatcaccccagctgatatcgaaagtaagtgaaatatctttagagtctgtttctcctttataaatggctttaggtccggtgtcagttgaaaacacgggaagcgggacagctctttggatataaaaaaagctggcagctgcaaatgcggcgataagtataataattaattgttttacccgtttaatgtgccacacatagaagtgattcactgatgatgcctccttatcttgtccatcattcttgttttacatcttatgagcatggacaattgaatataaccgataaaatgtctcttcacatacagcctaaattgggtgttgaccttttgataatatccgtgatatattattattcgtcgctgataaacagctgacatcaactaaaagcttcattaaatactttgaaaaaagttgttgacttaaaagaagctaaatgttatagtaataaagctgcttcgttaagcggcagtaatgatctttgaaaactaaacaagacaaaacgtacctgttaattcatttttataaatcgcacagcgatgtgcgtagtcagtcaaactagggcctgtacgatgcaggtcacacaggtgtcgccgcaggatgcggtgaacttaacctgtgatccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaatacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcagatttattaattctaccatgtttgtttatgaagctttatattattccgcagtagctcagtggtagagctatcggctgttaaccgatcggtcgtaggttcgaatcctacctgcggagccattgcttccatagctcagcaggtagagcacttccatggtaaggaagaggtcagcggttcgagcccgcttggaagctttatttaatgtattattaccaaggtttctcataaggagaaagctttttttattgcgatatgcggaagtagttcagtggtagaacaccaccttgccaaggtgggggtcgcgggttcgaatcccgtcttccgctccatttatcccaacgggatattgtaaattgaattgcgcccgtagctcaattggatagagcgtttgactacggatcaaaaggttaggggttcgactcctctcgggcgcgccatatcttttaatagaatagatgggaaatcgggaagtagctcagcttggtagagcacatggtttgggaccatggggtcgcaggttcgaatcctgtcttcccgaccattttttatggggccttagctcagctgggagagcgcctgctttgcacgcaggaggtcagcggttcgatcccgctaggctccaccaaaagtttttaaaaagttgttgactttgaagaagtgacgttgtatactaataaagttactttaacaaagcaaataaacaaaatgatctttgaaaactaaacaagacaaaacgtacctgttaattcagtttttaaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaatacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcaattgcacgttagtgtaattttttaaaaaaagttgttgactttgaagaagtgacgttgtatactaataaagttgctttaacaaagcggacaaacaaaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcaagcttaaacccagctcattgagctgggttttttattttatatctgtgccgatttgcttttatcagtatccattttatcaagcttctgctttttaagttttctaatacttttgaatccaatacaatcaccagcatgatcaacatgagagtcataaataatcaaaatgcagtttgtacgggagactcatccagactccatccgtctgcaattggcagaatagagccgccaatccattggcagcgagcagcatgcctgtcgtttgttctgtttttccatgatgaaattgattggtgacaattaagataatggcgaacatgctggccataaataagtcctaagaaaaaactaagaataatccctgcaaaagctgttttattgattgccaaaatacagagttaaatgaggccgctcatatttatcagcctgagataatgatgataggttattttttcggaaaccggctcgggttgccaaatgagagaaaagatattactgtcattaaaacgattcttggtttcatccggatatgataaaatgtctcagactatatttgagccatttttttcttcagcaatcatcttgcgtaattgataaaaatttattatgatactctttgtatgacaactccttgcctcaatacaatatactcaacgtttccccgttttctccggtcgtttttcttttcattttctcccgtaaaataaaaaaagctcccaatacaatagatatggtgcggatttattttttactaaaaaggagtcgttatatttgaataatagttttacattaaaacagcaatggttcgggaatatccgaaaagacattcttgctggcattttagttgcgttagcgttaatacctgaagcgattggcttttctattatagccggtgtggatccgatggtcggtctttatgcgtcattttgcatagccattattatttctatttttggcggcagacctggcatgatttcagctgcgacaggctcaatggcagttgttatggtgtcgctggttgctgatcatgggcttcagtatttatttgcagctacgattttgactggcattattcaagtgattttaggtatcagtaaaattgcaagattaatgaaattcatcccgcgttctgtgatgatcgggtttgtgaatgcgctggcaatccttatcttctctgcgcagcttccccagtttgaaggtgcttcttggagcatgtatgcgatgcttgccgggtcgttggttattatttatgtgctgccaaggtttacgactgctgttccgtctccgcttgtggcgattattgtgatgacaattattgcggtcactttccatgtggatgtgcggacggttggtgatatgggcaatatttctagttcattgcctcatttcttaatccctgatgttccgtttacctttgaaacactgcaaattatttttccttattcaattgctttagcgtttgtcgggttgcttgaatctttgctgacagcacagattattgatgaaatgacggatacggatagtgataaaaataaagagagccgcggacagggaattgcgaatatcgtgactggattctttggcggaatggcaggctgcgctatgatcggacaatctgtcattaatacaaaagcgggcggtcgcggacgtttgtcagcatttgttgccggtgcttttctgatgtttttaattgcggtgttaagtcatgtcgtggtgaaaatcccaatggcggcgttagtggctgtaatggttatggtgtctgtcggcacttttgattggtcttctttaaaaggtctcaaaaaagcgccgctcacggactcgattgtcacggttgtgactgtggttacggttgttgtgacagatgacttatctaagggtgtatttgtcggtgttcttttaagtgccgtgttctttgtagcaaaaatctcgaagctgaaaatcgtttctcatgcagaggatcaaaagcttagaacgtatcaagtgaaggggcaaatcttttttgcgtcagtgactgatcttacgaatgcgtttatatatcaagaggatattgagcgggttgtgattgacttaactgaagctcacgtatgggacgattctggtgcggccgcacttgataagattgttgcgaagtttaaggaacaaggcattgaagctgagttaaaaggtttgaataaagcgagtaaatctctaatgaaacagatggcataaaatagagaagcccagatgaatgagatctgggcttttttatataacatacacttaagcagcattgatataatagagagaagagaaattttaaataggggacttgcatatgatgcttcagaagctgaaccgtgtattggggagagtgatgccgctgttaacgccgactagtgtggtgttgggcgtgctgctgtctcagtttttaaatgggtatgaatgggctgtaccttggatctttgcttttattacgtttgcaggcagtttgagcgcgaactttcaatctttgagacatgcattgtctcatcctctccctatgattcttgcactattcgttcttcatattttcatgccgctttttgcttggggcagcggccatcttatatttaaaggtgatcctttgacgattaccggtttaacattggctgttgtgattcctacggggattacaagcttgatttgggcagcgatgtacaaagggaatgtcggtttgacactttcgattattttaattgatactgtgctgtcaccgctaatcgtaccgctgagtctttcattgctggccggcgctcaggttcatatggatgtgtggggaatgatgaaaggtctgattgtaatggtcgtgattccttcttttctgggcatgctgtttaatcagatgtcatctccagaaagaactgcgtctgtgagcagtgcgctgtcgcctttttcaaagctttgcttgatggcagtgattgcgattaacagttcagcgattgctccttatttcaaatccattgatttgagatttgcaggaatagctgtaacggtattctttatcgcgttaacaggctatgccgctgcttggctgatcggaaaaatgatgaaaaggcggcaagaggaaatagtctctcttatatttacgggaggcatgaggaatattagtgccggcgcagttcttgccgttacgttcttcccgtctcaggttgccgttcctgttgtgatcggcatgctgtttcagcagatattggctgctttgtttggctatatgctgaatcgttttgaattaaaaccaatgttgcagaaagcataaaaaaaccgctcatagggttgagcggttttttccgtatagccattcgagcgcgttgatgaactgtttgcagaaatacttgcggtggtgcaccgctcctttttcaattgaaagatacaaccggtcttcagtgaagcctttttcttttagactttgatgaacttgctttgtttttttcagcatatgtcgctgaatggattgtttttcacggccttcttcactcccgacagacatgaaaacacgtgtagtgccgggctttaaagaagatatatgaatggtttccgctgcgttctcgtaccagtatgaacctgatatagagcctattttcccgaacattgacggatattttaataaggcgaacattgagatgaggccgcctaatgaggcaccgatcattcctcttgactgcggttccctgatgacgttccagttttcttcgattagcggaatgaactggttcgttatatcagacagatagtgatatcccattccgccgaagtccgtgaaccgatcactgagtgatgcagccggccaaggtgtgtattcatttagccggttttcgggttcgataccgatcagcacgagttcagggagcctttgctgttgatatgcgctttctaataattcgatttggttttggaacaaagaactgccatcctgcacgtaaacagcaggaaatcccccgctgtctgtgctgtaggaaggagggaggtacagcgtgaacctcctgttgccggctttgtgttctgaaagagatcctttcaagcattctccccctttttttgcttgaaaagcagatataagaaataaggaactccgaggatcgccaaaatgatgcctgcgggcacttctgcgggctgaaaaaacagttttccggcaaagtctgcgcttatcacaagaagcatcccgattaaaccgctcagtggcaggatatagcgatgttcgacgccagccagtctccgtgagatatggggagcaattaagccgacaaacgccatacttcccgctacggagacacaggcgctgatgattgctacacaggctacgagcaggatggttttttctttatttgatgaaatgccgaggcttctgactgtgtcttcatcaaaacgaatggtgtcgagcaggcgggatttgccgataagaatcggtataaacagcagcatccatgggagaacggctgtgatatacgtccagttggcagaccagatgcttccgtttttccacaccatggccatttgatagtcttgcgggtccatttttaaagataaaaacaaagacagggcgctgaatcctgaattgatcgcaatccctaccagaataattcttcctgaatctaaattgcctctgtgccatgcaaatatgtaaatcaggatcgccgcgatgagcccgcctatcaatccaaagagcggcattcccatcgctgcagctatggatgtcacttccttctggccttggaataagagcataaacgctacaatgccggctcctgcccctgcgttgattccgagaattccaggatcagcaagcccgtttctcgtgatggcctggataacagcgcctgcaatgccaagaccgagtccaataatagcagccatgacaacccgcggcagccttaaatcgaacagcaaaatttcatactgcggattcgggtagatttgaaaaagagtggagagcagctcagcaggacgaacagaaaatgatccgctcgttaagctgaaataactgacaacaagaatcaaagcgatgaacaatgcatattttttagccattttgctcccctccttttcgtttaattaaataaaggaagaaaggtacgccgataatggatgttacgacctcaatcggtgtttcaaacggatagttgataaatctgcttgcgagatcacacagggttaaaaagattccgcccaaaatacaggagcacggaatcagcctgctgtaatcagagccgacgagaaatctcgtgatatgcggaacaaccaatccgacaaacgcaatttttccggccagcgctacggcactgccggttaaaatgatgacggaaagcatcgccatgattttaatggtttttttcttttgccccaggcttttagaaatgtcgtcccctaatgatacagcggttacctttttgctgagagaaatggccattataatgccaatcaggaaaaacggagcggcgagcttcaggaaatccggactcatttgatgaagtctggcactgtaccagaaactgagatcctgagaaatttgaaaataaatcgacatggccgctgataagctgctgagcagcatgcttgtgactgtgccgatgatggcgagctgcacgggggtaaatccgtttggcatcatggcggcaaggccgaatactaacacagctcctaacgctgagccgataaaagagtatatcatcatttcaatcgaagatgattgcgggagcagaaccatgcaaagcgtaatgataaacgctgaaccatctgaaacacccataatggatggcgaagctaaataattgcgcgtaatgccctgcataagcgctccagaaacagcaagggctgcccctatgagcagagcgccggcagcccttggaatccgggaatgccatataatttgatggtctgtgtttcccggatcgaaatgaataagagatgtaaaaacaatatctgtgctaagatgctttgccccataaaggattgaaagtaaaagtgacagcgctatagcaaatggagaagtaatcaatatgatacgtgtccactgttttgaatacatacaaaaacctactctgaattagttttgtgtcaatttttcagcagccgctttcaggaaacggactttgctccaagctgtgccgccttgtgcgagagggtccactgagttgacatacacatggtcttctttgactgctttaaggcttttccagattggatttttctctaaatcttttaaggcatcaggtttatctgcattttcatcatcagaaaattggacgaaaatatggtccgggttcatttcacttaatttttctaatgaaatcagctcttgcgcttttgcagcttttacttcgttaggcgccttaaggcctaaatcaccgtatagtgtggagttgaaatacacctgttcagggtaaatgtaaatgttgccttgtctaattctaatgacaagcgcttttgaatctttcgctttatcgttgatttttgtttttgtttcttttagatcttgttcatagtctgcaataattttctttgcttttttctcttttccggtcagctgggcaagcagcatcatgttttccttccagtttgaagagatatgagaaactgggatcgtcgtgcctgctgtgctgattttttgcagcgttttttccggaaactttgttgaagcaaggataacatctggcttcatttcaagaatcttttcaatatttggctccattttttctccggttggttcggctttatcagtgatgtctttgaacatatcagggaatttgccggagaatgaaattgcgccttgcggatgaacgtcaagcaatttcgcgtcttccattgattcaacgcttcccgtaatggcgattttgtctgtcggtacagttacttcatatgttttatcaagatattcaattttcttcttctcagatgctgtgccgcttgccttgctggcagttgattcatttttgctgccgcaagctgccgccgtcagcgcgagaagcaagattaataaggtaagagatatctttttcatctatagagcctcctgttcaattgataactattatcaattggaattatagagaatgaacagatataacaccatggacaaattcctgatttatcatggacaatctccggatagtaaagaaacagtttgctgaacgatgcgttcgtgcccgcaagctgagtattcattccacgggtcaagggatagaagataaacacggttatctcgtaccgcgcttaggttttgccatgcttctgtctgctgtaattgctggtagtaagctatggtctccggctctttaaaaagaaaaagcatcatacagtcagcttggtaatttgcgatattttctaacgaaatcgcttgttctgaaggtgtgtcagccgttgttgccgagctgaatcctaaatccccaaagaaaacttcgcggacacttcggttatgtgccagatagaagttttgcttatgcagcctcaaaaagagaaaacgcagcccttgaacgtgctgaagtgtttttttggcggctgttgtctgctggtcataatccgctagccacttttctgcttcggactcctcctttaaaaatgaggcagtttgcagaaagtgggttctccagctttcttctgaaggaaggtacatgacttctgcgatgcgattcaggcgatcttgttcttctggagaaatagaatccatgctgacaatcacatctggttctgcctgcgataacgtgtacaggttttcttcccacttttcattaaaccggtatgcactgagctggacgggtatatctgtcgaataatgctgatagtagtaagacgtccatttcggatgcagagcggccgcaaaaggtatgtggtgaagagggatgagatggcccattgtgccccttccgtatgcggcgattttctttcggcgttttttcatatagcttgtaggtgaacagcctgtatattttttaaagattctgctgaaataaaattcatcttgataaccggtttggtgtgcgatttctttcaatttgcagtttgattttgccatgagccgttttgcctttgtgattcgtgttttcgtaataaattctgttacgctctgtcctgtccattttttaaagctttcactgtagtgtttggcactgattcctgccatttgcgacagctgggcaagcgtgatttttgtatcggcatgtgtttcgatatagtgttttgttttttcgattgctgaatgtgtatccgtttgatcagataaactggcagtaaaaagatcataaatcaggctttgtacttcaatcacacattttagctgagaaagctgagacgattcattccatagtgcggcaagctcttgaagccggactgcaagattttcgatatgtgaaacattcataagcttcagtttggctaattccgattctgtgcacggtgtgtaaatatcttggccggcttccttgatatagctttgaagcctgatcagacaggcatctatatgtccatcggctgctggcataaagccaaaggtctcgttaggcggacaaacataaagtgtctttttttgcagaggattggtgtttgttccgatcgaaatatagccgtttccttttaaatgaaaaatcagcacgaatgaatcggctaattgctgttctgagaagagatcacttgtcttttttagatattcaatttgtatcggttgataaatcactgcattttgcacgagtagaccaccttttcagaagctttcaattgataatcattttcaataaaaattgtaccaaataaatgaaagttttcctatataaagcgggtgggtttttagcatgaaaaaaacccttacttatgtgtaaaagtaagggtctttcgttcagtaagaatatgttacacgtgtaacatacgatgcttacgttctaataaatgagatatttttttcttgttttgctgaattgttggagtgttttttcatagctgtttatgatgccctcaaccgaagttccattttcaatttttgtcctgatccagccgttgcctgccagtttatcgaatgaacctgttgacaggaactcaaaatcctcaggatagagatcgtgtatggttttaatgactgaaagacccgttttaacggcttcaaacttatctctgtctgtcacatagagctgcacaccgtggcaaagcgttccttgatgtttagaaaacgtcggtgtgaaggatgctgccctaaatgttacgcccggcaaatggaggctgtttaatgtttcttcaagttctgtgcttttgataaagggagctccgatcaattcgaatggctttgttgtccctcgcccttcggatatatttgttccttcaatcagcccggttgcaggataaacaaatgtgctttccaccgtcggcatgttaggcgaagggaggacgaaaggcaatcgggtatcgtcaaaatccatttttcgtttccagtgtttcatttttaccactgtaagatcggcatcaatatcaaattctttgttgaacagtaaagccaattcgcctatcgtcatcccatgcttcaatggaatgggatacaatccgacaaatgaggcgtattcaggttctaagattggcccttcaatatgattcccgccttggggattcggacggtctagcaccataaatggaatgccgttttctttagcggcttccattgcgtatgccattgtataaatgtacgtgtagaaacgggtcccgacatcctgaatgtcaaacattagaatatcgacatttttcagcatttctggagtcggttttttcgtttttccgtagaggctgtatacgggaaccccggttttttcgtcaatgtaagagcctacttcgtctccagcctgggcgtcaccgcggacgccgtgttcagggccgaataaagctgtcagtttgatatctgggttctcgtaaagaatatcgacactgcttttcagagatgcgtttactccggttggattggtgatcagtccgatgcgttttcccttgagctgttttttatagtctggcaagagcgtgtctatcccagtctggactttaggttttttagccgtttgattctttgaatcgggtgaagcagaggcagcggttatcgttccgaacatcatgagccctgtcagaaaagcgaatattgtttttctcatgtgtccctccttattaaagcggtcttcccgttttgatatttaatccgtagccatatggataaagggtgtcccccgggttcgtgactgatgggatgttaactggaagtgtgcctttaggttttgcctggccgaaaatcgccatcactccggccggaatattaggttgaagataacggccatttgcgtatcctttaaagccatagactgcaatcagtgcctttgcttcttcgaaattggcggcatcatatgggttgcgcaggctcattaagacaaatggtttgttgtgctgcagtgcggctttcatgacagctctcggaaacacggtggcccatttgcttgaatctgatattgtgtcgtcgatgacaccgtcgttgacgacagggtcatttttgacgacataggagccggttatgatataatcagccttttttacttgttttgcatgctcggcattaaatacttggttggcaaaattcattttgtcgacagatacgggtttgattttctttcgcttgatgagatcgtgaatggtttgttcgattgaagcagtttgttcttcgtaaggtgccacaattaagattcggctgccttttttaggcttgaacggcaaagtgtgctgttcattttttaatacagttactgctttttcagctatttttttctctgttttcaggtgctgctggcttcctacgatttttttggctttggctattttttcttttgtactgtcgctgtttcgtgctggatacatgccgcgttttattttcagggaaatgattctttcaactgatttgttgatttgttgttcaggaatatccccgtttttcacggcttctttcaaagcttgaatgacacgtgcgaatttctgttcttctttcattgaagtgactgaggctggcattaatgcaatatcgacaccagcttttacggccatgaccacagcctcctcctgtccgaaatgatctgcaattgccttcatattgagcgcatcggtaacgatgaccccattaaagcccatttcctgacgaagaagacctgtcatcactttttgcgaaagtgtagctggaaccagaatgtccgatccatcgagtttgcttttgtatgtggtgtcgtcgaaggcagggaattgaacatgggctgtcatcaccatatcagcaccagcatcaattgctttttgaaaaggataaagctcgacctcacgaagccgttcttggccatgggaaacgagcggcagtccataatggctgtcaacgtccgtgtctccatgtcccgggaaatgtttgagggcagacgcgatatcctgccgctgcaaccctttcatcgtatatagaccgaggcgtgatgtcagttctcgattggagctgaatgaccgtacgccgattacaggattatcaggattattgttaatgtccacgacagggctgaaatctgtattgatgcctaaggcagagagctctttcccgatgatgctgccggtctgatacgcattgattctgcttctggctgcgcccagcgccatattccctgggaaattagtgccctcccctaacctcgttacaatgccgccttcctgatcaatactcagcatgagcgggatttttggacttgccttttggtaatcgtctgtcagttggacagtttgttttgttgtttttacattttctgcaaaaaggatgatgcctccgaattgatatttcttgacgaggctggcgacttcatcattcatttctgtaagggcttgcggagaggactcgccttccttttgccaatttctaaaatcaggcatcagcatctggccgagtttttcatctaacgacatacgattgacaatctgattggcatcgattgaacgtttggatgcagaggcttctgtctgtctggccccgaaaaagcatgaaagaaagagaacggctgaaaggataagcggaaagacaggtctcatagaaacttcctcctatcgtctaatcattcactccatcgcttcataaatcgcggttatgacacttccataactgcctgttgcaaattgatcaccctcaaagacgtttggattttcttccggatcaataactggtgtatgctttttatttgttaacaatgcgatgcctaaattgtatgctggatcaataattgtaactgtccctgtccagccggtatgcccgtaagcattttcactggcatgagggccaaacatccattccacgcttttacttccgttccgcctccagccaagagcgaatgtcgggtctgttgctgaaggtgctgtaaacaggtcggctgttttctgatcaaataaagaaatgtttcggtatgaacctttgtttaacatgacttgcagcagtatggccatatcatctgcatttgagaacaatccggcatgcccagacacgccatccattgagtaaaacgctttttcgtcatgcacctctccttgcagcgtgtttgtgcggatgttagggaattgaataacgccgtcacgtgtattgcccattcgttcagtagctgcgaactgtttcggtttaaagcccttttgcagcggattgtacaaggtatgcttcagcctgagcggtttgtagagctcttgctccgtgtagacatcaagcggtttgccagtgagtttttcgacaatacacccaagtagaatatatccaatgtcactgtatacgtgttttgtcccggtttgataatcgagcggaattttcgtcaaatattcaatcgttttgtcccgttcttgggaatagtacttaccggctttttccggcgtgtaaaagtaaaagcttgatgggagtcctgattggtgctggaggacatcgatgacacgtatcttgtcttttccttttatgaggtcacccggctgatccttgaaacccggcaaatatgcagaaactttttcatagacgtcaagttttccttggctgactaagcgctgcaatgcaaaatttgttgcgtacatttttgtatttgaggctaagtcaaacatcgtgcgggttttcattttggccggacggcgcagcagttctgatccttcgtactttttactgtagccgtatgctgctttttttatgatgcgtccatccttcaccaccacaagaacggcgcctggaaatcctgctgcaatatcccgttctatcatctgatctaccttctttagcttcttcgtcgagaattgtgcagtttctgcatttatggttttcggctcaaccaagttgtctgctgtttgtgcgaaggtttcatttggcgcgaatatcgatagggttaaaatggcactgaatatgaacagtgtctttgttttcacaggctagcccctttctgtgcttctatcccgtttactatccctaaaacagaaacaatttaatcgaactgagaagccatttcatctttatatccgaatgcataggtcaataaaaagccggccgcgtaggaaataaagagcccaacgatatacaggatgatttgcgaaggcaggactagaaaggaaagcggcagtccggagacaccaatcgcaatggtggctacttgaaaataagcttgaaaggcgccgccgattccagctcctaaacatgctgttaaaaacggacggccaagcggcagcgtgactccgaaaataagcggttcaccaatgccgagcagtcccgatggaagcccgccggcgattgctttcctcagtgttgtttttttcgtcttcacgaaaacggcaaaggccgcgcctacctgtcctgcacctcccatagccaaaatagggagcagaggatcattgccaattgaattgatcagttccatgtgcacaggcgtcaagccttgatgcagtccggttacgacgagaggaaggaaggttgcgcccagaataaagcccgcagcgatgccgccgatgtccaggatggacagtaggccggatgtaatagcatcagaaatgaatccgcctaaaggcataaatacgacatacgttacgattccggtgattaacagtgaaacggtgggtgtgacaatgatatcaagtgattgaggaataaaacggcgaataaattgttcggtgtaagcaatgaatatggctgcgaaaaggacgccgatcagacctcccctgcccgggagaagctcttctccaaataaactgatttttgcgatctccggattgataatcaagatcccggccaaagccccaagtgcgggtgtcccgccaaattctttcgaagcgttaataccgacgagaatgccgagataagtgaacagccctgatccgatgactgtcaggataatcgcaatttgtgagtctgcagagagccagcctgcttgaataattgctttggtaatcccagtaattaaaccggaagcgactagagcgggaataagagggataaaaatgctggcaattttacgtaagaaaagtttaaaaggagtggcatttttccgattgatatcggctttctttttggccgctgcttctttgacatcggcaccttcttctgctgacacgagctttgagaaagcagctgtaacatgattgacgactcctgtgccgaggataatttgtaaggtttcagcttcaacgacccccaatacgccgtcaagctttcttaaaccctgagcatctgctttgctttcatcgtaaggcgtaatgcgcaggcgtgtcatgcaatgcgtatatgaagaaatattggattttcctccgcatagctcaaggattttctgtgcgagatgatggtagttattttctttgctcattaaaacccctccccttcaagatgccttatttttttctcatagattggatggctgctctcgttttatcgatataaccggttgtcgtttcatactgctcagccgccatgcctaaaaacaaaacatcaattataaaaagctgggcgaggcgggaggaagtggccgcacttcgaatcaaggcttcattggaatgggctgtatacaaagggacatcagccagtgcggagacggatgtctgactgaattgtgtgaggctgatcgttgtgatgcctttttccttggccatggcaaacagttcaatgatttcctgtgtctctcctgaaaacgaaatggcgaatacgatgtcgtctttatctgcatttgcaattaaagatgccacaagatgagtgtctgtaaacgcggttgcttgtttatgaatgcgaagccacttttgctgggcgtccttggcgacaatgccggaagcccccaggccgataaaatgcacggtatgagctttgagaagcagagaaaccgctcgttcaagctctttgtagtccatcaggtctgaagtatcctgaatggcttgaatggcattgccggccgttttttcggaaatggagggcagcggctcgtggggaacaatatcccggtagccctgaaacgtaggctttgccagatcgcccgctactctcatttttaaatcttgaaatccttttaaaccgagtgatttgcagagcctgatgacggcagcgtcacttgaattggctaaggcgctgatttcgttgaccgtgctttcgattgctttgtggggatgggctaggatataatctgcaagtttgcgctcggatggagggagcttatgcttcattgattggatgatggctaaaccgcctgtggccattctagttctctccttatcatggatggtaatgttcgattgctttgtcaatgaaaccgtttgcttcatcgagtaatgtctttgcttgtttctgatctgtgcttgttttgagcatgacgattgctgttttgacgtgatgatcggcttgttccagagtgtatctggctgtgtcgtatgaagcgtttgtaaggctttggataatgctgatggcgcgttcttttagttttttgttgctgacgttgacgtctaccatcaagttttcgtaaaccttgccgattttgaccattacagcggtagatatcatgtttagaatcattttatgagcggttgcggctttcatacgtgttgatcctgtaatggcctcaggtccgacgacaacctcaatgctgtgatccgcatccttgctgatggcggaattttcattgcaagtaagggcgatggtgtgtgctccgactttgcgggcgtatcttagggcgcctgcggcgtagggtgtgcggccgcttgctgcgatggcaatgacggtgtcatttgaagtgagctgtatgtttcttaaatcttcagctcctgcttcatcactgtcttcaatgccctctgctgcctgtaaaaaggcttcggggcctccagctatgattccgatgacctgatctgggcttacgctgtaggtgggaggacattcaacagcatccatgacgccgagtctgccacttgtgccggcgcctgtatatatgagccggcctccattttgaaacgattcataagcgcagtctacagctgttttgatgtcggggagaacctcttgaacggctgcagcgactttcatatcttcgttgttgatcattttgaggatgccgagagtgtttgctttgtggatttcaactgtttggctattgcgtgattccgttgtgagacggtgaaggtttaatggttctgacatgaggatgccccctgttttaaaatgatatatctcaatattcagtatattcatttctgttatgatatttcaactatgtttttgaatttttgaaattttatttcactcaagtctataagaaatgatgaaggatcaactgttctccaagcgggccgattcttcgccgtcctttatcaaggaacccgcttttcatataaaggtgttttgcgcgtatgttcagatgattgacggccaagatgatttcgtcgcaccatggaaaatatccgctcacaaaagcgggaagcaaaagcatggcttttttcgcatagccttttccgtgatgcacagcgtttaaagacagggagctgagcagtaaagcaaatggattgttagaataagaagcaagcgtttcttttgatgcatgtaaaatgaaaaaaccgactggaaggtcgtcttttaagatgacaaccgggtatcggtcctgtatgcccagagcctgagacagcacctctttcgggagggaggtaaagcgtttgtcatcgttggtgagcgtgaatgattgaagctcgggcaagtgttcaggcttatagaaggataaagaaatgtcttgagtcatgtggtggcctccttacaatatgtcgtcaagctcgttttccgaaatgacgcggtagcccgcttgttttaacagtgcggcggttactccgctgccggtgatttttttaccagagaatgtgccgttatagataaaaccgcttccgcaagatggactgttttcttttaatatgacggcagaagcgttgatttcttttgcgtaagccaatgttttcgcggcgccttccatatatagttctgtgacgtcttctcctgaagctgtcacgattttcgctgttccattgagaacatcctcgccggtgcctcctatgatttctgcgggttcgcgtggggtagagaagccgccgagaagttcagggcaagccatgactgctttcttttcatcgacgagttttctgattttctccgacgctgcgtgagagccgttatatctgcattcaatgcctccaaggcaagaactgactagaatcatattgggttctcctctcttgctttacttgtctctatcataaaataaatggctttagttgggaggctttttcagttaaaaaaggagttaaaaagtttgaaaataaaaaaattaatttttctctttacaaacagggagtgacctgtatataataacttttgtcagctcgacgagaacacaacggcccgttggtcaagcggttaagacaccgccctttcacggcggtaacacgggttcgaatcccgtacgggtcaccatttggaggattagctcagctgggagagcatctgccttacaagcagagggtcggcggttcgagcccgtcatcctccaccatcttgccggtgtagctcaattggtagagcaactgacttgtaatcagtaggttgggggttcaagtcctcttgccggcactgttttttcaaaattttatgtggaggggtagcgaagtggctaaacgcggcggactgtaaatccgctccctcagggttcggcagttcgaatctgcccccctccaccattattgggctatagccaagcggtaaggcaacggactttgactccgtcatgcgttggttcgaatccagctagcccagtcacagacacctttgatcaaaaggtgtcttttttcttttcgggaaaatcattccaacttctaactgttcagtctgtataataattttaaaaatatgttaaggtagtttattcacgaattaccatctacaccctgccaaaaatttgataaacttattttataaaaaaattgaaaccttttgaaacgaagctcgtatacatacagaccggtgaaggcagaggttagataaatatggaaatgatgattaaaaaaagaattaaacaagtcaaaaaaggcgaccagaatgcatttgcggacatcgtagatatttacaaagataaaatttatcagctttgctaccgtatgcttggcaatgtgcatgaggcggaggatattgcacaggaagctttcatcagagcgtacgttaatatcgacagttttgatattaaccggaaattttcaacttggctttatcgaatcgcgaccaatttgaccattgaccgcattcgcaaaaagaagccggattattacctcgatgcagaggtggctggtacggaaggcttgaccatgtattctcaaatcgccgcagatggtgttttgcctgaagatgcagttgtgtcgctggagctctcaaacacgatacagcagaaaattttaaagcttcctgacaaatacagaacagtcatcgtattaaagtatattgacgaactctcattaattgaaatcggggagattctaaacattcctgtggggactgtgaaaacgcggattcacagaggcagagaggctcttagaaaacaattaagggatctttaagtggggtgatgaaatgagctgtcctgaacaaattgtgcagcttatgcatatgcatcttgatggagatatccttccaaaagatgaacacgtattaaataaacatctggagacatgcgagaaatgcagaaagcatttttacgagatggagaaatccatagcgctcgtacggagcacatcgcatgtcgaagcccccgcggattttaccgctaatgtcatggcaaaattgcctaaggagaagaaaagagcttctgtaaaaagatggttcagatcccatcccgttatcgcagctgctgcggtattcatcattttgatgggcgggggtttttttaacagctggcataatgaccacaatttcagcgtgtccaagcagccgaatcttgtggttcataaccatactgtgaccgtgccagaaggtgagacggtcaaaggtgatgtcactgttaaaaacggcaagctgattattaaaggcaaaatagacggggatgtaaccgtcgtaaacggcgaaaagtatatggcctctgctggacaagtcaccggtcagattgaagaaatcaatcaattattcgactggacatggtacaagatgaagtctgcggggaaaagtgtactcgatgcattcgatccgaacggagaagagtaaagcgcgttagccgctttgctctttttttgtgggctgagagggctggcacatttcacttgctaaatcgaaatgtggtataatgggctcgctatgtaaagtacatatgcgtaacacgtaaaacacaaaatacgaaatgactgaaatcttggaggacgaggaaatggcttttgaggatatcccttttttgcagtacctcggcaatgccgttgatattctccttgtttggtatgtgatatataaattgattatggtgatacgtggcacgaaagcggttcagctgttaaaaggaattgtagtcatcgtgcttgttcgtatggccagccaatatttgggcctcagcacacttcaatggctgatggaccaagcgataacatggggatttttagcaattattattatttttcagcctgagctgagaagagcgcttgaacagctaggccgcggccgctttttttcgaggagcggcacgcctgttgaagaagcgcagcagaaaacgattgaggccattacaaaagcgatcaattatatggcgaaacgccgtataggcgccttgcttaccattgagcgggatactggaatgggggattatattgagaccggcataccactgaatgccaaagtcagctctgagctgctgatcaatatttttatcccaaacaccccgcttcatgacggtgcggtaattatgaaaaataatgaaattgccgcggccgcctgttatctgccgctttctgagagcccgtttatttcaaaagaactgggcacgcgacacagagcggctgtcggtatcagtgaagtaacagacagtttgacgattattgtgtctgaagagaccggcggcgtcagtgtggcaaagaacggcgaccttcacagagagctaacagaagaggcgctgaaagaaatgcttgaagccgagtttaagaaaaacaccagagacacttcttctaaccgctggtattggaggggcaagaaaaatggataaattcttaaacaaccgctgggctgtgaaaatcattgctctgcttttcgcgctcttgctttatgtggcggttaacagcaaccaagcaccgacgccgaaaaaaccgggtgaatctttctttccgacatcaacaactgatgaagcaactctgactgatattccggttaaagcgtattatgatgatgaaaattacgtcgtaacgggtgttccgcaaacggttaatgtcacgataaaaggctcgacaagcgccgtgaaaaaggctcggcagaccaaaaactttgaaatatatgctgatatggaacatttgaaaaccggcacacataaggttgagcttaaggccaaaaacgtgtcggatgggctgacaatctcaattaatccgtctgttacgacagtgaccattcaggaacggacgaccaaaagttttcccgtagaagtggagtactacaacaaaagcaagatgaaaaaaggctattctccggagcagccgattgtcagtccgaaaaatgtgcagattaccggatcgaaaaatgtcatcgataatatttctcttgtaaaagcttcagtgaatttggaaaacgcagatgaaacgattgaaaaggaagcgaaagtgactgtctatgataaagacggaaacgcgcttcctgtcgacgtggagccctcggtcatcaagattaccgttccggtgacaagcccgagtaaaaaagtgccctttaaaattgaacggacaggaagccttcctgacggtgtcagcatagcgaatattgaatccagccccagtgaggtaacggtttacggctcacaggatgtgttggattctcttgaatttattgacggcgtcagcttagatttaagtaaaattaacaaggattccgatatcgaggcagatattccgcttcctgacggtgtcaaaaaaatctcaccgtcaaaggtgactttgcatatagaagtcgacagtgaagcggatcagaagttcgagaatgtccctatcaagactgtagggctgagcagctcacaaaacattgaatttcttgatcctgaatcacaagcgatagatgtaacggctaaaggctctcccacgaatataaaaaagctgaaaaaatcagatattgaattgtatgtgaatgtttcagatttagaggacggggagcatagcgtgaagcttgaagtgaacgggccacagaatgtaacttggtccttggggcgtaaaaacgccaaaatcaagctgacgtctaagaaaagcaatacatcaacgaatgataacagcagcaatacatcagggaaccaggacacagataaacaaacaaatgatcaaaagaacaatcagcaagaagatacaaagaacactgataaaaacaacaacgatcaaaaccaagacgaaaataaagatcaaaaccaagatcaggatgaggatgaatccactgcgaattcacaatcctcatcggaataaaaaaggagcgattataaaatgggcaagtattttggaacagacggtgtaagaggtgtcgccaatagtgagcttacacctgagctggcctttaaagtcggacgtttcggcggttatgtgctgacaaaagacaaacaacgtccaaaagtgctgataggccgcgatacacgcatctccggccatatgctggagggagcccttgtcgccggacttttatccattggcgcagaagtcatgcgcctgggtgttatttctacaccaggtgtatcttatttgacaaaagcgatggatgcagaggcgggcgtcatgatttccgcttctcataacccagtgcaggataacggcatcaaattctttgggggagatggatttaagctttctgatgaacaggaggctgaaattgagcgcctgatggacgaacctgaggataagctgccaagacctgtcggagcagaccttggacttgtaaacgattattttgaaggcggacaaaaatatctgcaattcttaaaacagacagctgatgaagatttcacaggcattcatgtggcattggactgtgccaatggcgcaacgtcatccttggcgacacacctgtttgctgatttagatgcagatgtttctacaatggggacttccccgaacggattaaacattaatgacggcgtcggttcgactcatcccgaagcgctcagcgcgtttgtcaaagagaaaaacgcggatctcggccttgcattcgacggtgacggcgaccgcctgattgctgtcgatgaaaaaggaaatattgtagacggcgaccaaatcatgtacatatgctcaaaacacctgaaatcagagggccgtttaaaggatgatactttggtttcaaccgtgatgagcaacctcggcttctataaggcgctcgaaaaagaaggcatcaaaagcgtacagacagctgtcggcgaccgctacgtagtagaagcaatgaaaaaagacggctacaacgtcggcggagagcagtcaggacatcttattttccttgattacaacacgacaggggacggattattgtctgctattatgctgatgaacactttgaaagccacaggcaagccactgtcagagcttgcagctgaaatgcagaagttcccgcagctgttagtcaatgtgagagtgactgataaatataaagttgaagaaaatgaaaaagtaaaagcagttatttctgaagttgaaaaagaaatgaacggcgacggccggattttggtgcgcccttcaggaactgaaccgctcgtccgtgtcatggctgaagcgaagacgaaagagctgtgcgatgagtatgtcaatcgcattgttgaagtcgtccggtcagaaatgggattagagtaacgaagtctattatcagagagtgaacaagacaagcgaggtttacataagataattgtgagacatacggcaaagttgtttaaaaaacaattgaccgtttatgccacatgttgtaaaatcaagcttgtcttgttcttattttctcaataggaaaagaagacgggattattgctttacctataattatagcgcccgaactaagcgcccggaaaaaggcttagttgacgaggatggaggttatcgaattttcggcggatgcctcccggctgagtgtgcagatcacagccgtaaggatttcttcaaaccaagggggtgactccttgaacaaagagaaatcacatgatcttccaaaaaacatgtaggaggggacgattgaaagtccccttgaaatttgactttcttcgtctccttttacaatcttaggaggaagaaaaatatgtgtggaatcgtaggttatatcggtcagcttgatgcgaaggaaattttattaaaagggttagagaagcttgagtatcgcggttatgactctgctggtattgctgttgccaacgaacagggaatccatgtgttcaaagaaaaaggacgcattgcagatcttcgtgaagttgtggatgccaatgtagaggcgaaagccggaattgggcatactcgctgggctacacacggcgaaccaagctatctgaacgctcacccgcatcaaagcgcactgggccgctttacacttgttcataacggcgtgatcgagaactatgttcagctgaagcaagagtatttgcaagatgtagagctcaaaagtgacaccgatacagaagtagtcgttcaagtaatcgagcaattcgtcaatggaggacttgagacagaagaagcgttccgtaaaacacttacactgttaaaaggctcttatgcaattgctttattcgataacgacaacagagaaacgatttttgtagcgaaaaacaaaagccctctattagtaggtcttggagatacattcaacgtcgtagcatctgatgcaatggcgatgcttcaagtaaccaacgaatatgttgagctgatggataaagaaatggttatcgtcactgatgaccaagttgtcatcaaaaaccttgatggtgacgtgattacacgtgcgtcttatattgctgagcttgatgccagtgatatcgaaaaaggcacgtaccctcactacatgttgaaagaaacggatgagcagcctgttgttatgcgcaaaatcatccaaacgtatcaagatgaaaacggcaagctgtctgtgcctggtgatatcgctgccgctgtagcggaagcggaccgcatctatatcattggctgcggaacaagctaccatgcaggacttgtcggtaaacaatatattgaaatgtgggcaaacgtgccggttgaagtgcatgtagcgagtgaattctcctacaacatgccgcttctgtctaagaaaccgctcttcattttcctttctcaaagcggagaaacagcagacagccgcgcggttctcgttcaagtcaaagcactcggacacaaagccctgacaatcacaaacgtacctggatcaacgctttctcgtgaagctgactatacattgctgcttcatgcaggccctgagatcgctgttgcgtcaacgaaagcatacactgcacaaatcgcagttcttgcggttcttgcttctgtggctgctgacaaaaacggcatcgatatcggatttgacctcgtcaaagaactcggtatcgctgcaaacgcaatggaagctctatgcgaccagaaagacgaaatggaaatgatcgcccgtgaatacctgactgtatccagaaacgctttcttcatcggacgcggccttgactacttcgtatgtgtcgaaggcgcactgaagctgaaagagatttcttacatccaggcagaaggttttgccggcggtgagctaaagcacggaacgattgccttgatcgaacaaggaacaccagtattcgcactggcaactcaagagcacgtaaacctaagcatccgcggaaacgtcaaagaagttgccgctcgcggagcaaacacatgcatcatctcactgaaaggcctagacgatgcggatgacagattcgtactaccggaagtaaacccagcgcttgctccgttggtatctgttgttccattgcagctgatcgcttactatgctgcactgcatcgcggctgtgatgttgataaaccgcgtaaccttgcgaagagtgttactgtggagtaataaatgtttaacccctttggataagattgtctaaaggggtgtttttatgtccaaaagagaaagaacgtctacagtggaaaaatggattaaagaaggtgatgggacaggactcgactatctatcggccatggctatagatttaagatgtttccacattaggtcggtcaatcaggttaaaaggcattaagacttttgcctaactgagttttctaatgttaatacagatataagagagcagttcctcattatgaaacgcttttgatagcagttggaataaagcatgctagaaatccgaaaaccggagagcctattggaatgataacgtgtttttttattgtcaattaataaaggcaaaagaattctagaagtcgcacttacaatgtacttgtgggccttaggttttaaagctcattctttttttattgagtacattccggtttaagttgaaatgattcagtaaaggacacgccataaataaaaggtagcgtatgattgccattctttccatggaaccgatatttctaagatttcatctttcgtaggctttcgattcatattacgtaatatttttatcgaacgaattagacccacatcatcgattggaaaagctgtcgggaacctaaggcagcgcattagaacataattggctgtccaaggaccgattcctcgtattttaattaagtttttttcagcatctttaaagttcattttcattaatttttccctcgataattccccacttgccattaatctggctattccaatgatatattcacttttttttaccgtcattttaatatctgccaggtcggtaggggttaaccgtgcaattcgctcgtacggtgggaacacccaatactttttaccattccattcaatagaatcgccaaatgcttctacaaattgcttctttaaggagtacgcgaaggctaagttaatttgttgccctaaaactccccaacataaagcttcaaataaatcgggaatgccgatcactcgcaacccataaaattttcgggcaggcattttaagtaatggatctgcttttgccatttcataaaatggagttaaatcgttatcaagatcaaaccattcatgaatatattttacaatctcttcccgtttccactgctcaacaggtctagaatcgtttaggaattgaacaatcatttgtttattattgattacgcttacctgcactaaggaccgaatttccccaatggctataacttttgtaatgatattgttctctatttcatacatgcattcatttttttccctggttaggtagccaaggttcgcattcatgtcgaaaatttcaggtaatgtaatgacaataacatcattgacttcatgccatgtcactttttcattctccttatcttaaataattataagaaaactcacgctggttgaaattagtttatcacataataagctttactcattttgttatcttgctattacattctaaccaccttatttttttctatttatgaggttatagtgttagttatcaagaatgctaaacgggagtggattaaaatcgcccaagatataaaaacgtgtgtcgaaaacgtaaattgggattcaagtcaaaatgaattagatgagcattgtaaggaggggtgagataaatgccggatagtatcaataacggacataaagagagccatgatcagagaaccttaaatgatgtagaaatgctaacaaatgaaaagtggcatgcaattataaataatgatgcagcgtacaataatcaatttttctacgctgtaaaatcgacagggatattctgtaaaccatcctgtaaatctcgcgttccgaaaaaagaaaatgtatgtatttttccaaacgcagaacaagctctccacgcaaattttcgcccttgtaaacgttgcaagcccactaatgaaaaaatgcctgatagcgagtgggttgatctaattactgaatacattgataaaaatttcacagaaaaattaacgctagaatcgttagcagatatttgtcatgggagtccgtatcatatgcatcgaacatttaaaaagattaaaggcattacgctggttgagtatatacaacaagttagagtacacgcggctaaaaagtatttgattcagacaaataaagcgattggagatatcgctatatgtgtgggtatagctaacgcgccttattttattactttatttaaaaagaaaactggacagacaccagcacaatttcgtcaaatgagtaaaatggaggaaacgtacaatggaaacaaataaaccaaccctttattggtctttactaatgttcaagaattgggatttttatattgcttcaactttaaaggggcttgtgtttgtaggttcacagaacaaaccaatcgaggaattgttcgaatgggctaagaaacgctttccaggaagtcttcttgttgaagatgatgataagcttgaaccctatgctgttgaaatcactcaatatctagaaggaaagcggaaaaactttactgttccagttgagtacgccggtacgcaatttcagctagccgtctggaatgcactttgtgaaattccttatggacagacgaaatcctattccgacattgcaaatgatataaataaaccagcagctgttcgtgctgtaggtgcggctattggggctaatccggtattaattactgtaccgtgccatcgtgtaataggaaagaatggctcattaactggctatcggggcggatttgaaatgaagacactgctcctcgatctggaaaagcgagcttcatctgaaatggatgttcctcattgaaagtgaatcatctataatgggttggattcttttagaggaaagtaaagaccagtttactgataaacttgacaacttttaaaatttagcatatcttatacgtaacttaataatcgatgcagatgtttatttttccttttaaaatatgtaggcctttagcattcttttcatatttaattttaaatattgataggatgaaaaagtatcctaataaaaaaggaagagaacatgagtcgatttatttgataatcaggactatattaaaggaaatgaaaacatagcataaagtaaagaccaataataaggtagcacttcaaaaaacttcgctgaagttagttgaagtgaagccgacaattttcaggattcaatgatctaacataatcattgaaattttgaagttgtcggcttttttgttggaaaaaaatagagataaataaaaattgaaataaataatagacaaatatgatctgattgaaagatcttttgaccaataatgagttttaaaaaagggagaatttagaatgttagtttcgctgagtttgtcatcattattaacattattttttattatgcttatggcttctgggattagtggactattgtttttacatccgcgagtacccttgagttttgttcgcattcatattgggatcttggctttaccacttttggtttccttactgattcttgccgatagtggtgtgagcggaaatgttggcccttggcacttagattccttagcttgtttaatgactttctttgttcttgcaattggattcatcattcagcgtttttctgtacgttacttaatgggggatcgatcttatcgaaaatattttacgctttttactttcacaacaggagctgcttctatgacatggttaagtggtgatctccgcttgatggttctattttggggagcaactcttgttggtttaaccttacttataaggttaaacagtgcttggcaagtggctagtgaagcagccaaaatttctggccggttatttttgttaagttggttttctttgttttttgcgatgatgtggctttttcatgccacaggtcaatggcagttatcattggttgtaacaaatgaaagtttagctgggctgggagaatgggagagaacagggattcagctattgattgtactggcggtgatcattcctgcagctcaatggccgttccaaagatggttggttgagtctattgttgctcccacccctgtttctgcaattatgcatgcaggtttagtaaatgctggaggaataatactaactcgattttcacctctatttcatggtggtatcgcttcgattattttacttctgcttgctggcatttctgtattgattggaactggaattagtttagttcaggttgattataaacgccagttagtaggctccacgattggacaaatggggtttatgctcattcagtgtgcattaggcgcctatatagcagccattattcatcttattttacatggtttattcaaagctacgttgtttctacaagctggttcagcagtagggcgtcatgaagtatcggctcgcactaatgaaagaacatcctatttatggatcatggctggtcggattttatccttagttataggtgttgctttttggctcactgctcctggagacgggtatcacttaatcagtgcgctgatcttagggtggtcattgtccgtttcttggactcagcttgtcgcttttggagagggccgaattggccgaattgccggcttaactgttttaggaggagcagccctcgtatattttatcattcataaccttttctataagtggctgcatacaaccatttttcaaagtgttcaacctccaatgtcagctgtcatgattgtcgtatgtctcttactatttggcagtgctttaggtacgtgggttgctcgtcatcgttcttccgtttttttcgcggtactctatctttggttagttcgattaggtgaagcaaaaccaaagtcagtagagagtcacccagactaccttaaacaatatatttcataaggagctaatctgagatgggcattacatccgtattaacgaaagataatgtaaaaaagatagatacagatattgatgttcaagaaagggatcttaacgttttcattacatctgccagccgagtgattgcgccactttggcctatttctacatttgctgcacgtaatccgtggatgggacttgaaaaccaaccttttgatcaggttgcaagttggttgaaaaacactcgcgatgttgatatatatcctagtgcgtctatgatccgttcagcaaagaataaaggtgagattgatgaagattttgtggaaatggggctgcagcgttggcttgattcacattcctatcacatcccacgggacgtggcagagcgattttgtcatgctgcattaaagttagatcccctgccttccgaccttttatcatcacatgagctggagaaattagtaagtgaatgtagtggattggatcatatcgagaatgtgtttatgcaaccactaagttcgtatatagagaatcaagatggtgaaaggctagtcaatatactagatcatcatgtcattaagtggagtaaattatatcttgatgactctcaagcaggctggacaatgcctaatcgtgaggaaggtttttatcgtgcttggcagcatctcattcaatatgatccagcacttagtaaaaagcagcgagaaagggtaaaaggttggccgaaagaggcacatttggctttacaggaagctttattcgcactagaaatcccagagtcagaaatccagacttatcttgaaggtcatttactttcattacctggatgggcagggatgatgctttggcgctcccagcaatcgagccacgaacatgcactcctaacagaatatttagcggttcgaatatccatggagtgggctcttataaagccatacttacctttgactaatgaacgatctaagaaaaaaatttcaattgctccccttatagcagcttggattcattggggtgggcttacattagaagaatggtcacagatgacggccattgaacaaaacgaatatttatcatttgcctacagctttgatgagaaacttcgcaagaaactttggttagaagcttgggaacaaacgtacactgatcgattaagccagaagatcatctcgaaacaacgtgaaaccggcggtaaaaaatctgcattagctcaattagcattctgcatcgatgtacgatcagaaccttttcgtcgtcatctagaaaaagaaggcccgtttgaaacgattggtattgctggtttcttcggggtgccgattgcaacttgtgaacttggcagtaaacacagtcatgcttccttgccgatcatacaaaaaccgcaaaataaaataaaagagttcgcagatgaggatgtattcaaaaaatacaatcaacggaagcaagcaattcattctttaagccatacctttaaaacgatgaagcagaatgcgctttcgagcttactactgcctgagctaagtggaccttggcttactctgcaaatggtagcccgtagctttgtgccaagaaaggcgggtcgtttcattcgtaatctccgtgaggcttggttgcgcaaacctgatacaaaactctcgcttcatcatgatactacagaggcagaaatacctgtgggttttactgatgaagaaaaagtgaactatgctcgccaagcattaaaaatgatggggttaacagaaaacatcgcacccttggtcgtgatctgcgggcatggcagtcaaagcactaataatccttattccgcagcccttgattgtggtgcctgcggtggagcggccggtggattcaatgctagagttttagctgctttatgtaatctatcagaggtacgagaagctcttttagctgaaggaattcaaattcctgaggatacggtttttgcagcagctgaacataatacaacagtagatgaattacattggctttatgtaccagagctttccgaagctgcacaagaagcatttgaacaaattgaagccgtgatgccgaaagtgagacatcatgtaaacgcagaacgtctagcccaattaccgaatttccaatcgaagctaaaaaatccgaaggctgaggcaaaccgatttgcggaagattggagtgagatacgtccggaatggggactggctcgtaatgccgcttttattatcggtaaacgtgaactaactcaggattgtgatttggaaggcagagcctttctccataattatgattggaagcaggatgaaagcggtgaactcctagcaaatattattgcaggacctggaactgtagcccaatggattaatttacaatattacgcatcaacggtagcacctcattattatggcagcggaaataaagcaactcaaaccgttactgcaggtctcggcgttatgcaggggaatgcaagcgatttgttagccggactgccttggcaatccgtcatggaatcagatcacgaggcctatcattctcctcttcgtttattgatactcatccaagcacctagagaatatgtagaacggttattaaataatgattcagcatttctgcaaaaagttcaaaatggatgggtccgactggctagtcttgatccagaaggatgttgggaaagctggtaatgatgaatctaagcatttatcaaatggatttgttattcaaaataaaaatgataaacataaggaagaggtgtgctgtatgaatgtaaaccaaaataaaaaagtattatttttgacggatattgaaaacggtttggagcctattttacaagaagcgactaacacttctgcagagaatatgttgactatacaaagctatggtgccggtatttcacatccttatggagaaatcatgaggtctgttatttttgcgatttaccaggaagatgttgaggagatttttgtagtaggaacaaaagataagaagacttccgcaggtaatggactaactcaacttgaaacaatgaaagataaaatacaaacattggattatctttttcaaaattgcaagcctgaatttttaggtggtacggtcgatgaatggctaaatgaaaatagcagtgacaccattgaaaaaagtgttgatatgattcgacatcatcccctagtgccgtcatatgttaaagttagaggtttattcgttcatcataaggatggaaaaccctcaatcgcggagggtcctgatgctaaaacaggtcaagccatacctgatcattgcttgtcacgatgaaatacaggttcaacttctaaacgcacccatatatggagaaagcagttctaaggagattgtatgagcgctaatttaactgattttgtcacgaaaacaatagaggacatgaactcgtttgatcgtgaaaatatggaatttatgaaaaaactaattagaaaagcaattgatttttatcatctaaagtcttatgaagaagttgaggaaacccattcaggaaatgttcgatttttgcatgtccactctatgatggaagaaaatatgttatccaaaatgatagtggtcacaagaaacggtaaaactgatttggatattgaaggtgtatatgaaggatatgttgtaagagaatattaatgagacgaaatcacaaatagaatatgccaatttttttgctcaggagatgtattagatatgaaaaagtctaagggttctattgaatcagagatcagtaagtccattactcaatgggagaaggattatcttgggcgggggtctgtatctgttaagactgatatactgcgggacatgatcatcgtcaatttaaaagggattttaacaccagccgaatatgtagtttgtggatcaaaagagggtatgttatctatcaaacaaactcgttcggagttagttgaatcaggtatagaaggccttaaggatattatcttaaaaataaccggagaaaaagtgaaaagttttcatactgatttaagctcccggacaggtgaacgagtgatggtatttaaattatgtaatgatctagagaaaaatttggaaaagatcttataatctaaagaaaataaatgttaagacggtatggaatttgttgtgaattgaacataaagaactgccgattcttttgttttacaattatggtatcattgataacttttattcatatcctaagcggacataaagagatatcaattcatagtacactgttgtgttattcctgtcgaaagatctaacatccgctgttgttatgagcggatgtttttttacatctattttaaatacatgaatttgatgctggtgattagtcacttgaacaatatttgaaaacatccttgtcacctgccgggtttccccaagtgtttagtgacatgattatgagaccaatttcgtaaagcttgctgataaatttaagcggtgaacaaaattgatatgctgtcttcagtttcatttcacggaattagtcagagataaacctttaattaaatatatccaaaaaacggattgacatatcgaaatataacgatataataatcgatatggaaccaattgaagtattcaaagccttatcaaatgaatcaaggctgcaaattttgcaatggctgaaggaaccggatcgtcattttgcaccccatgaagggattgatatgaacacaatcggggtatgtgtcagtcaaataacagacaaattgaaaatgacgcaatcgacggcttcccaatatcttaccatccttttaagagccggcctaattaaggcggagcgtattggaaagtacacatattacaaaagagatgaagaagccattgggaaacttgctgactttcttaaaacagagatataaaaataaacatcaaaagatgtttatttttacaccatacatatcgacatattacgatgtgtttattttttataataacatatcgataattcgtgatatgtttattaataattaaggagtgaatgttttatgtctaacacttggaaaatttatattttagccattgtcagctttttagttggaacctcagagtacatcatttccggaattttggatcaaattgctcatactctcgggatcactttagctgccgcgggccagtttattaccattttttcacttgtatatgctctttctacacccgtacttatggcgttgacagcaagtatggatagacgcaaattgatgatgtatgccctaggtttgtttgtgttcggtaatgtcctggcttttgtattgcctggttatggatggtttattgcagcgcggatcattatggcgatgggagcaggtgtggtggttgtcaccgcattaacgattgccgctaagattgcatcggaagggaagcagggaagtgccatcgctacggtcgtgatgggatttaccgcttctttaatcattggtgttccgcttggaagaatgatagcagtagcattaggctggaagtctgtatttggagccattgctttgttgggattgatcgcaatggtcgttattttctttactcttccgcatactgaaggggataagcctgtgcctttgcttcaacagcttgctcttttcaaaaaacggaaagtggctatgggattatcaatcactttcttctggctcgggggatattctgttgcttacacttatttgtcaccgtatctcttgaacatctcaggtataaacggcaacttgcttagcggtgttttgcttatatttggaattgccagtttggttggatcaaagtttgggggatatagcaccgataaatggggagtgccctttacactcgttggcgggatgacgttgcatatcgtcacactgattcttctgtcacttgtcactcattcctatatcggagtgttggtgattctcatattatggtcgtttgccgcatggtccaccggtccgacacagcaatttcacctggctacaatagaaccggaaatgtcaggtgttttgcttagcatgaatcagtcaatgatgcaattcgccatggcggtcggcgcaggtataggaggggtttttgtggaaaacgtatcattggcctcgattacctgggttggtgcgttaggggttatgattgccattattgcatcattgctgattttcaattcgcaaccgaaacaagcgctaaaagatatcaatcaataatttcgaaagatctaacatccgctcgttatacaagcgggtgtttttttataggctcaagtagaaggcacactgaagctgaaagggatttttgccgacggagagcagaagcacagcaagttataatatactaggaagggaaataacggtatggcagaagggttctagcgcttctcgcctgtaagatcattactttgaggatgtgtcatcgtgaatcaaaagacgtacattgaaatgagcaggacatcgcagtacatcaacaaaatgagagagtattcagtgctaattgatggggctgagatgggaactatcaaagatggaggaaggctgcgaattgatttaccgcctggtgagcatgttattcaagtgaagattgcttggtgtacaagcccaactttgaggtttactttagcggaaggagaagtgttgaagtttagatgcggaagtccgcttcgaggttggaagttgcttttggcacttttttctgttttgggccgtcctgaaaattatctgtttatcgagcaggaagaagagaaaaaagctttgtggtgactgtatgttactacatggataaatatcgctgaattctgttttgtgaaagtttaattgacataagaaagaatggcagccttctcaatatcgtgctccttagagcaggctgtcaataaggaattctcggttgtcaattttcataaattcattgagaaactaaatactccttaatcaattgccacctgtcacgagcatgcatgatgaactccgatgcaatggctacaaccaggtttttctccggaacacagcaaatcacattcccgccatcgcctagtgctgagtatgagaaaacgccgtcctcatcactcagccaccatagataaccgtagttattggggtttatctctgttgattcgtcaatccatgatctccgaatgatctgttgattgttccaagtaccatggttcaaatatagataaccaaaccgagccatatcccgtggagtcagcgtaagtccccatcctccggttgagttgccgtccgggtacctctcacatgtttaccgaatagatcgtcaaagctgaatgatttcatttcataatgcggaatttctttcatgccgatcggtttaaataagtactcgttggcaaattcgcgggcgcttttgcctgtggtgcgggtgatgatggctgacagcaggtgtacgcctgcggtggagtatttaaatgtgccgatttttcctccttgacccagcataccgagcgtataggcgatccaatctggctgcatgcacatcttatcgagcggttcttgccagtcttcaaatggatagggagctgtcattgtgagaaagtggtgtcttgtttttgtttattaggagtattcgacacattctgggaaagaagcagtgttttccgaataaatccagctccaagaaaccaaatctaataaatggatctataaaaacgttaaaatcaaaagaactaatatatataggctaacgaaagagatatatcattttttgaaaaatagttttgattgcttatagttgacgagtattaagtgaaaacaatccaaaaaagtccctaacctaaattttaaatattaataattagatgcggttagagaaaaataagttaaatatttgaaaaaaatgttgaaaaaagacatataaaatgatattattacctatataagtaattaatttcttaaggaggaacgaaaatgaagaaaaaaattgctgcatttctactattaacaatagtagcgataagcacgataattcctgtcacagtatctgctggaagcggggaaaagtggaactatggttatgacaaaaagaaaatgcaggattacaatgattactaccattggctttatcgtcacaattcgtcaataacaaaaaaaggtataaattatccaggtcgtattgcccaacctaaatattggtccaaattaagactcgattataccggtccttataaagtttcctaccacaaacacgtttacaaatagaaaatttttcaaaagggatttatattataaaatataagtcccttttgcattaagataaataaggagaaaatatgattgaaataaaaaatatgaacaaatcattcaatgaaagaaaaatttttgaaaacttaaatttggttattgaacctggggagtttattggaattattggaaagagtggaaagggaaaaactacactgctaaatataattggcacgttagaaaaagcagatagtggttctgtaaaaatattagatagggatataaatagaaaaagaaataaaagatatttacttagacatcacttaggatttatatttcaaaactatgcattaattgataatgcatctgtgaatgagaatctagaaatcgcacttaaacataagaagatgaatagacaacaaaaaagaactgctatgtcttctgcattaaaagaagttggtttagataactatggtaaagaaaaagttcatactttaagtggtggggaacaacaacgcgttgccattgcaaggctgctgcttaaaaatcctactttgattttagctgatgaacctacgggatcattggatactgaaaacagagatattataatatctctttttcaaaaactacataaacaagagaagacaatcattatggtaactcacgataaagaactaataaaaattttttcaagaactctacaattataaagggggaatagattgtgaaaaaattattattccttctcgttattactacctttatagttgtaagtttcctatcgataaagcaatttgaatatttacagtttcaatcttttaatcataataatgttcatgattcatggaatgttgttatagatgaagggaattctaaaatcggtaaaaaagataattttaaaatgttggaacaaatagcatttgaatctaaagttaatttgcaacgcatatcatatgaaaatgataataataaagataaagtagtgtattatgttgttctctataatgcaccagaatattttaaagatctaaaactaagatatggggaatttttgcaaagtaatagtagttctaatgattttctatctactgttcaaacaaagaataagcatcagataggaacattagagatatttcatagttttgaacctattgaaattaggccaatgattgctgcggaaaaaacaaaagatattaaaggtacctatactgtaataggtgaaaaacatgctgaaaattttaagaaaatcgcattacagcatggtttttcaattaagttatccaaaaatgaagattcacaaagtgtgagtacaccatatccttatcaggaaatgatgtatataagctcattgattttatgcttattaataatgcttacaatattatatgatgtaagtaataactataaagaaattgctgttaggtatatgttgggatgtaatttatttcatataggaatatatctattcagaaaatatattcctatcattataagttccttgcttgttggaagtttaggtttaatattatatttatattggtataatcactatcaacaattcattgagttcgtatattttttatcgaaaaacattgctctgttatcaataatacttacaatcatttttttaataatatggtttagtactggaagtatcaatatcccacaaatgattaaaaataaaaaaccagtaagaatgtttttttatttaaatattattgtgcgctttgtactggcagtttttctattgttaggtttagagcaggggattagcaaatttcaggtgttaaaaagtacggtttcgaatcaagaaaaatggtctttgttaaaacaatattcttatttagggatgatagcttcaccagagcaaaaacaagaaactcttaattttcaaaaagataaagaagagcgaaaaaaaattcaacttttctataaaaaactagaatcccaaggggcgttttttatatatccttcggacttttactcgaatgattcacaaattacatctcaagacataaatccatggggagaagagggaagaaaagtagaaataaataagaattatttatcggttaatatgataaaagatatacatggaaaagatgtggggataccttcctctaataaagatgtaataaatgtgttagtaccaataaaatttaaaatgtataaagaagatattgaaagatcattagcagaagattataaaggtatatacgatataaaacgcgctgctcctgtaaaaataaatattatctatgtccagaataaccaatcttattttacgttttctacaaattcagctcaaaacagtaactataagattgtagatccgattgccgtaatagttaataataaatttgaccctttgatactagctaataatatttctatggggtatggtttttataccaaaattagtgaaggtaaagatcctttcaaaataataaaaagaacattagaggaatatgaattaaacaacatatggagccctgtatctattgcttattcaaatgtcgaattaaaaatagccaatgataaagaagcattacagttaacggctatatattgtggggtatttcttttgttagctgtagtattattaattttttcggcagtttattacttagaaatgaacaaaaagctattatcaatacaatggatatttggttatagcttttttgagaagcattgtttggtctatctctcggtgttggttttctggagtctgacttttatggttagcttttatgtatctggaaatattgcgttattgggtgaaatttccttatggttggcgattttagacatattattaacaagtatattattgattatgagagaatataatgttactaaacaagtcttaattaaagagtgattagtacaaataattgggggtaaacatttttgaaaagaaaaataaaatttcttacgatttgtttagcgtttgcattattatgtctaattatagctgcctattctatctcaacgaataaaccggatgatgaaaataatattaacaaaaatcaagttggaaaaacacaaaaacaagatagttcatattcagataatatggtatctgatcaagataataaatactatgtcatctatataaaacagaagaatggaacaggctcatcatttgtgcctgaaaagcttaatcctggtttcaaaaatgactctgatgattttaacgtaagtatttcctttgatgataaagggaacgtaattaataatgataaggtaattgaagtggaagacttctcactatcaaatactaataagaaaaaaattagaaaaatagttggtacaaataaatatgatgcagctttgaaagaagttgaagatcgagtgttagagactaagaaagaattagaagaaaattccaataattagtaaatatacaattagcagtattgaccgctgtaaataagaggcggtctttttgcttagaattaaatatttactaggtttaatagaaatttattttcatatcgtatccttttcgtattacgtgaaaggagcactatgaaagttgtactgactatagtttaccttctagacggagaataaaaaagagccggataaccggctcggtataagttaaaactgctttgttacgtcgtattcataatctatttttgcttttacgttgctcatcgtcgatctggctgtcgctaatgtattatatttaaaactccatacctttgccacactgagttgatctgacaaagagatatcataagaccctgaagtcgagctgtttacaagagcacggcgccattcgttgttttcgctcgtcatgatcaggtggcgtgtatttccctggcttggtgtttgagtggcggttgtctgaactctggttacaatggcatcacgcggtatcccagattggtttgttaaatcaaccttgatcacgctggagtcagaacctgaggggctaaggcttgtatttcctttattttcagcaatgccgctgaattggaatgttccgctgcctgatttgattcggtcttcaattgaaagtgtaaaatacatgtttccggtataggtgcctcgtgacactttcacataaaaggtatccgtcgtgttttgggcgtctgcatttgcataaataaaagaagaaaacgtattagggttaatgacttctgtcccttgagaaacaggtattctattcttatcataaatttcaattttcatccctgtatacgcgctctggtatgtactcctcacgtatactttttctcccttattagccgtaaaagtgaaataggcttcatcttgaccagcttccagtattgttgtatcgatatttttatatttccaataaccgatcggcattgcggtatcaaatgaattgtttcctgtgatagcagtgactccgacagctgatgccgaatacgtaaaggtgaataagacagacagcataacagcgaatggaataagccattttttcaccatgcaaacaacctccttttatttccatcatacataataacgatttaggtgtaaataaatgttttttgaggttaatatatacattatctttgccgataaaaaagaataagagagaatactcgggagggaattcaatgcgtctgaatcggcaatttatccgcactcagctgatggcacagaacatattgagcaagaatgcgcctgccaaacgggagaatgcgactgaaaatccagcggcagttctggaaaaggcatacagcaggcttaagtcacaatcttcaactgggggaatcaatcagttcaattattctaaaaccagcgtgtcgggaaacagcggggcgttcagcaaagtgtatcaatcagcgaatgatcgaacagtgacagacacaggggaagaaacagtgattcaatcccaaaacccctatgaatctgagagtgatatcagaatcaaaatactagatgaaaaatacagcaggatgaatgcgattaataaaacaaagtctgatccattaggctatattaaggataagtaccaaaattcaaagtctccttatttcagaagtgatctgtcagctgcagaaagacaggccgcttacgataatgaaacagaatggttattcaaagggaaggcgcaaaactataaccttcaggatgctgtgtttcggaatgtcacatttcatggggaagtggaagctgagaatgaaaaggtgtatcagcggggacaggttaaccagcagctgcaagtactgttgaatcgaaaccatattcatattccagaggggacagagctgacgtttacaatcacaccgattgactatcaggtgcgggtaagcgggacagacgatcaggatctgatcaagcaaattgagcaagtgctgcaatctggagacaacagcaaagaactatttttgcacatcatgaaaagccaaagcagtgattcagcacaattttccgaagaggcctatcaaaagtatcaggctgctcgtgagatgtatgaagttacaggctaccatttgaaggatttagaagtgattgatgggcggtacgtcacgcctgagggacgtgacttaatggatgtatataaggaagagcttgaaaaagatccagtgcagaaacaaacggcttcttatgctatatcttactatcgttcagagctcagtaaaatcgcggaagccgggtataatgccattccggatttcatcctatcaattgattacagcaatggatctctgagagatgtgggacaaagcaagagctatgggaccggagataccgggtggcttgaagcattaaagcgtcaaacgggtgtgaattattaggtaagctgttcatgtaggacagcttattttttatgagaatctaaggggtgaattaatcccaatattcaaataattttattatttttatataaaagattttaaaagaagtgaacgattcaaaactctgaacaaaggtgtttgcctgaaaaaaacaattgtattttccagagaaatttattatgatgaaataagtaatttaggagattatataacaattttaagtttgaattttctgattgttatcactgattcatgtgaaggcaagcaggtctgctgttttctcatttatgagtattttgttaggaggaggaagaggagtggcaaataaagaattaaagaggggcctgggcgcgcgccatattcagatgatcgccttgggcggtacaatcggtgttggcttgtttatgggttctgccagcacgatttcatggactggcccatctgtccttctggcttatgcaatatgcggaatttttatcttttttattatgcgtgcgatgggtgaaatgctgtatgtcgagccgagcacaggttcttttgcgacgttcggccatcaatatattcatccgatggcaggttatataacagcatggagcaactggttccagtggattatcgtcggcatgtcagaaattatcgctgtcggttcttatatgaagtattggttcccggatttgcctgcttggatacctggtatcgtggcaatggtgattcttggtgcggcgaatttaatttctgttaagtcgtttggcgaatttgagttttggtttgcgatgattaaaatcgtgacgattatcttgatgattattgcgggaatcggaattattttcttcggttttggcaatggcggagatgcgatcggtttgtcgaacctgtggtctcacgggggcttctttgcaggaggtttctcaggtttcttctttgcactgtctcttgtcattgcagcctatcaaggagttgagctgatcgggattacagcgggtgaagcgaaggacccgcaaaacacgctaagaaatgcgattcaaagtattatctggcgtattttgattttctacattggcgctatttttgtgatcgtgacggtgtatccttgggatgagctcaactcactcggaagtccgtttgtgtctacgttctcgaaaattggaattacggcagcggccggcattattaactttgtcgtgattactgcggcaatgtccggctgtaacagcggtattttcagcgcgggccgcatgctgtatacactgggtgtcaatggacaagcaccgaaattctttaagaagatttcacgcaatggtgtgccgctgtatggcacaattgcggtgctgatcggtttggctgtcggcgttgtactgaactatatcgcgccgccgaagatctttgtctatgtatacagcgcaagcgtgctcccagggatgattccttggtttatcattttgatcagccatatcggattcagaaaagcgaagggtgctgcattagataaacatccattcaaaatgccgtttgctccttttacaaactatttgacgattgctttcttgctgatggttctggttggcatgtggtttaacgatgatactcgtatctccctgattgtaggcgtgattttcttagcgcttgtggtcattagttattatgtgtttgggattggcaaacgcacgcaggccaatttgacaaaaagcgaacaagcagctgaataacgataaaaaagagacattcacggatgtctctttttttatttttcgcgtatggattttccctattttagcaagctatagggtaaagatagcagaaggaaaggtgttcataaaatggatgttacactcggttatttgcgcgaatcactttcgaatcatctagaaaatgaagtctgccagcgtatttgcaagaagatgctggcgaagcgttatgcaaatgaaggggaatttgtaaaagacttagatgataatgaaatgtcttttttgaaccatgtattagaaaaagaaattaagtatgcccagaatgaacaggatcaaaaacgggccaaggaattaaacgaggtgtatgaattactgctttgagaaaggcgggtaagaaatgggagcaattgaacgaagcggatatacatttcagccggagtttagcgttgtccgtcaaaacggagccatccatgtgtaccatcaaggagagtttgtggaagaaatcgaatttgaatttaacggggaatatcccgatcatgatttgattgaagagcttgtgaatcattattgttttgagcatgaaatttagagccctgccgtgcagggctcttttatttaggatgtgatcaggccatactttttcaggatatccacggtgatgtttttggcttttgtgccggaatcatcgacattggtgacaaagacataagagccatgctctgttttgatgaatccgacaaaccatcctaatcccatatctgtcaggcgagttccggttttcccgtagagcgtgtaatgatcgccttcctcttgaatcatcatgcgcttgacggttttcattaccggcttgtcaaatggaagctccttgttagccagtttctccaaaaaagtttcttgttccagcggagatattgtgagcgagctttgcagccaaaactggtcgattcccccgctgatatcctcgttgccgtaagatagtgtatgaagccatgttttcattctttcctcgccgatatctctcgctaatgcctgataataccagattgcggattcgcgcatggccgagccaagcgtatggtcgcggttccatgattcgaattcacgcttgaccccgtcccatcgttttacatcgtattcatctcttacagctttgacctgcaagccgattaaagcgttcacgactttaaaggtggattgcggagtttgtctttgatttgcccgttttctgttatagacaaatgtctgatccttttgtaaatcgtgaagaatgaaggttccatccgtatccttgaattcgtcatcgacattcattctgctgacattcaagtgtttttcatgagcagatgatgctgcgtggacggagaagccgccgatccctgcaatactcagcacaagcacaatatatatccattttttcattttgttctcccctttgttttgattaactaccttttctctctttcgtttgttcttcctttaaaaaataatcaaaaagcgcttaaatttggttttgtaaacaaatactgttactgggtttatagtcggaagataacgtgaaaatagagggtaaaaaggaaggcagggtaagcggatgaatgagcagattccacatgacaaaagtctcgataacagtctgacactgctgaaggaagggtatttatttattaaaaacagaacagagcgctacaattcagatctgtttcaggcccgtttgttgggaaaaaactttatttgcatgactggcgctgaggcggcgaaggtgttttatgatacggatcgattccagcggcagaacgctttgcctaagcgggtgcagaaatcgctgtttggtgttaatgcgattcagggaatggatggcagcgcgcatatccatcggaagatgctttttctgtcattgatgacaccgccgcatcaaaaacgtttggctgagttgatgacagaggagtggaaagcagcagtcacaagatggcagaaggcagatgaggttgtgttatttgaagaagcaaaagaaatcctgtgccgggtagcgtgctattgggcaggtgttccgttgaaggaaacggaagtcaaagagagagcggatgacttcattgacatggtcgacgcgttcggtgctgtgggaccgcggcattggaagggaagaagagcaaggccgcgtgcggaagagtggattgaagtcatgattgaagatgctcgtgccggcttgctgaaaacgactcccggaacagcgctgcatgaaatggcttttcacacacaagaagatggaagccagctggattcccgcatggcagccattgagctgattaatgtactgcggcctattgtcgccatttcttactttctggtgttttcagctttggcgcttcatgagcatccgaagtataaggaatggctgcggtctggaaacagccgggaaagagaaatgtttgtgcaggaggtccgcagatattatccgttcggcccgtttttaggggcgcttgtcaaaaaagattttgtatggaataactgtgagtttaaaaagggcacatcggtgctgcttgatttatatggaacgaaccacgaccctcgtctatgggatcatcccgatgaattccggccggaacgatttgcggagcgggaagaaaatccgtttgatatgattcctcaaggcggggggcacgccgagaaaggccaccgctgtccaggggaaggcattacaattgaagtcatgaaagcgagcctggatttcctcgtccatcagattgaatacgatgttccggaacaatcactgcattacagtctcgccagaatgccgtcattgcctgaaagcggcttcgtaatgagcggaatcagacgaaaaagttaaattaaaaagctctcttcctttatcgaagagagctttttgattacttctttttttcatcgtagtattggacgggatacatggagccttctgataccattttgttgtcctcgatatcttgcgggtccgggtggccggctttatcaactgggaacgtttccatgtctggctgttttgttattttcatcttcatgctgtgaatgaattctcttgccttttggcgatttgacgggtcttttaatagataagaagtgatgccgacagttgaaacagcgagacctgaaagtaacagcttttgtttcatggtgatactcctttctattttaagaatagtgtttcctgtatcattcccgttttggaaatagctaaacctattgtgtttttatcgtttggattaacagtaaattccatttaagaagaaactagtgacttcattcctgtattggaaggtaatatacattgacttattatcgtttcagtcaaaattcgataaatattgacaaagtaaagtaatcagaataataatataattagtaagagaatgtcatcatacatgaaaggtgtttacgatatgaatcaattgcatcgaagaatgggaacgttttccctcatgatggtcgggctcgggtcgatgatcggttcaggctggctgttcggggcttggcgtgcggctcaaatagcaggaccagctgctattatttcatgggttattggaatggtcgtcattttatttattgctctttcttatagtgaactaggttctatgttccctgaagcggggggaatggtaaaatatacgcaatattcacacggttcgtttatcggttttattgcgggttgggccaactggattgcgattgtgtccgtcattccggttgaagcggtggcctccgttcaatatatgagttcttggccatgggaatgggcgaaatggacaagcggtttggtgaagaatggaacgctgactggggaaggactagcgtttgcctctgtattgcttctcatttattttctgctgaactattggacagtcaatctattttcgaaagcgaattcattaattacgatttttaaaattattattccgggtcttacgattggagctttgctgtttgtcggattccacggagaaaactttactggcggtcaaagcattgcgccgaatggctgggcaagtgtgctgacggcggttgccacttccggtatcgtttttgcgtttaacggtttccaaagcccgattaatatggcgggtgaagcaaaaaatccggggaaatcaattccgattgcggttgtcggctctcttttcgttgcgacagtgatttatgtcctgctgcagatcgccttcatcggagcggtgaatccttctgatattgctcacggctggagccatttgaattttaattctccttttgctgatctggcgattgcgctgaatattaactggctagttattgtgttatatgcggatgcatttgtatcaccgtctggaacagggattacgtatacggcgacaacgtcccgaatgatttacggaatggaaaaaaacaaatacatgccgagtatattcgggaagcttcatccgatttacggcgttccgcgacaagcaatgttctttaacttgattgtgtcgttcatctttttgttcctgttcagagggtggggcgtattagcggaaattatttccgttgctacgttaatttcttatatcaccggcccgatcacagttatgacattgagacggacggggaaagacctgtacaggcctcttcgtttaaaaggcttaaacgtgattgcgccgcttggatttatctttgcgtcactggtgctgtattgggcgcgctggccgttaacagggcaggttctgtttattatcctgatcggtcttccgatttatttctattatcaggcgaaggcgaaatggaaagggtttggccggaactttaaagccggcgtctggatggtgttttatctgctggccatgatggtcatttcttatttgggcagtgataaattcggcggcctgaatgtcattcattatggctgggatatggttctgattgcgatggtatcacttgtattctatgtgtgggcgctgaagagcggctaccagacagaatacttaaaggatgcgaaagagataaattctcagctgcttaatggacagtcagaagctgctgccggaaaagaataaaataaataagaaaaccttgcgatagttgtcgcaaggttttttgcttttaataacccttttttactttgtggaaaagatcaggatagttggtgaacactcctgttacgccccaatcaagcaggcgatgcatatcagcttcattattgactgtgtaaggatgaagcaggaggccgtggctgcggatcatacggacgttttcttgatttaaagctttataatccgggcccgcaccgacagcgtatgttttgatttcttccagggcagcatctgtcattgacgccatttgtttggcttccagcaattgaacggtcggcaggtttggctgtaattgatggatttttaccaggctttctttgctgaacgattgaatgatcacctggcctggcttagaatgcttccccagtaatttatgtttctgcaaagaagcgatcagtttttcttccatacctgggtaggtgtcaggcgattttgtttcaatatagtagttcgcgtgctttccgaaacggtctaatacctcttctaatgtaggaactttaaggccgacgtactgcggctttgctttttccggataggcttcattaaaccaagaaccggcgtcaagcttcttaatgtctgcgagcgtatggtctttcacccagcccgttccggttgtggtgcggtccagtttttcgtcatgcatgacaatcaatttcccgtcttttgtcatttgcagatccaattcaatataatcagccttcattttctgagcggtttcgtaagacagaatcgtgtgctcaggcacatatccagaagcccctctgtgcgcgacggtcaggatacggtcaggtgacagcaggtttccttttgacgctgccgacactggcgttaccataaatgagagtaagcccagcgacagaacaaacaaggccagtattctattttttctcatgatttctcctccttatagataagcactacctgtctttcatattaaaaaacggatgtaaacggcgtgttggaaaactattaatcttttatgtgtctttcttaaacatgctctgcccgttttcctgtattccacgtcaaagccaagaagacgatggcaagaatacaggatgagatcagcatgataaagccgccgttccagttaaaacggtccacgacaaagcccataatggcgtttgcgaaggcggatccgccgatgtatccgaaaaatccggtcaaaccggctgcagttccggctgcttttttcggtgctagatcgatcgcttgcaggccgatcagcataacaggtccgtagattaagaagccaatgctgatcagggcgatattgtctacgagcggattgccggccggattcagccagtacaccaatacggcaatgaaaacacccgccataaacaaaacgcctgccggtgcccggcggcttttgaagaatcggtcactgatccagccgcacaagatcgttcccggtatgcctgcgtattcgtaaagaaaatacgaccagcgtgagtcttcaggagaaaagcctttggcttctgttaagtaagtaggcgcccagtcaaccacgccgtatcgcacgaaataaacaaatacattggcaaaagcgatgtaccaaagaaatttgttgttcagcacatattgaaaaagaatttcttttgttgttaattctttttcctgatttttaaaagcgtgttttggatagtcattccgatactcttcaattggcgggagtccgcaggattgaggcgtatcacgaaccaataaaacaattaaaaatgaaatgataatggcgatgatggcagggaagaaaaacacgcttttccaagtgacgaacatcgcgatcccaagagtcacaagcggagcaagaataccgccccctatgttatgggcgacattccagatcgacatttttgtgccgcgttcacttatggagaaccaatgggccatcgtcctgccgcatggcggccagcccattccttgaaaccatccgttgataaacataaaaataaacatgatggtgacgctcgaagtcacccaaggcattgaaacgaatagaatattaacgattgctgataaaaataggcctgtcgccagaaaatatctcggattacagcggtcagacaccattcccatgatgaatttgctgaagccgtacgcaatggacacagcggccagcaccaaacccagttctgttttcgaaaatccctgttcctgcagataaggaatggcaaaggcaaagtttttccgcagcaggtagtagcctgcgtagccaatgaaaataccaatgaatacttgcagtctgagccgtttgtatgccgcatccatctttgaatcatccagtctctcaatatgaggagccggtttaaatatattaagcattaaaattatccccctttgctgtttgtgctggatgtgtggcgtgcctcctttcccgaaaaacaaaaagagccagaaaacaccccttgtcaaaaggggttggattcctggctctcctcatctccatccaagctattaacttatcatgatagcgctttcttaaattatcatagtccggagcgaatgtaaacgggtaattttcaaattgggccttagggaagtaaatattatccttttactaaatgcagttatgtttttttactagtaacataaaaatctggagggaggctgtttaaaggtggatgaattagatatcgcattctttattttaccgttaggaattatgctgctatcgattgtcgggacctgtatttgtaaaaatccgtatctgatgccaatgcttagtttggtgatttctcttgtgctcacctttaccatttttattgaatcatttttgggatgggctgttgtctatagcttggtttctctggctttatcctatatcacattgattgtggtaaggaaaaggaaggaatcaggaaattaaaaagacctcactttctaacatatcgttgactaaggcaactatatgtgattataattggcttagtcaacaatattagaaagtggggattgatttgaaaacaagagaatcatctgtcggattaaaattcagaaagttcaatcgattttatacaaacgtccttggtttccttaatgagcacatttacgacagcccgttttccttaacagaaacacggattttatttgagatttataatacgcctaattgtacggcaaaagctcttcaggataagctggggcttgaccggggatatgtcagcaggattgtgaagcagtttgaaaaagaagatttgatctataaacagaggagcaaagatgacgcccgccaccattatatttttgtcacagaaacaggaaaaacgatttataaaaagctggaggagaaagccaacgaacaagtagaactgatgctgaatgaaatcaaccaaaaggagcagcacaagcttgccgaggcgatggcagagattgaagcgatcctttcacagtcgctttctgccagatcatcagagatatcgattagagattattttctctcggaggatcttcaactccttattgagaaacaaagacaattttacgcggaggctcacggttgggatgacacgtttttagcttatcttcaggagacatttgacgctgaaatcgaaaaaatatggattgcggaaagcggcgggaaatttgccggctctgtcgggttggtcaagcatgatgaaaagacagttcagctcagatggtttctggttgattcggattttcggggcagggggctcggcacgcaattgctggagcatctggttgcatactgccaagacatgaagtttgaccgcattttcctttggacggtgagtaccatggctgaggctcgtccgctctatgaaaaatttggattcaagataagtgaagtgaaacaagaagcgccattatggggacagcagctgacagaagaacggtgggatttggagctgtcatgaaaagactgcattatgcttgggtcatcgtctccgtcaccttcttgatcttattggcggttcagggggtgcggctgtcatttggtgcgtttgtggagccgtgggaacggcagttttcaatggatagaagcaccatctcgctgatttcgacgatgagttttattgtttatggcatatcacagcctgtgattgggcggcttgtggacaaatggggtgctcgggctgttttggcatggagtgcgttactgacaggagtcagcattttcttaacataccttgtgacttcgccttgggagctgtttttgctttacgggctgggtgtctcgcttggagttggcggagcatcgaatgtggcggcaagtgtattggtcgtcaattggttcagcaaaaatcggggactagcctttgggatcatggaagcaggctttggcgcggggcaaatgcttctcgttcccggctcactcatgttgatccattggtttagctggaagctgacggttgtggtgttgggactgctgttaatcgtgattgtctttccggctgcgctgctgatgctgcggaacaatccttcagaaaagaatacagagccgataggcggactggctgcatcagaaaaagaaacagcacccaaaacaacagctctttcagtggccgggatgtttcgtatgaggcaattctggttcttgatttttccgtttttgatctgtggttttacgaccgtggggctgatggatacccatttgattccgttttctcatgatcatggcttttcaacgacagtcacgagtgctgctgtcagtctgctggcaggctttaatattgctggcatcttgctgtccggaattgtagcggatcggtggagcagccggaaaatcctgtgctttttatatgcggtgcgggcgctgtcgatcgtgattcttatttacagccacgagccctacttgcttttaacctttgcgattctgtttggattagtggattttgcaacggtagcaccgactcaaatgctcgccacccagtactttcaaaactactcgatcggcctcatgattggctggctgtcactcgcccatcagatcggatcggcactaggtgcgtatgtgcccggcgtcatctatacggtaacgggtgagtatacactggctttttatttgtcgattggaatgctcgtgcttgcgagcgtaatgaatgtgatgctgagggagcctgcggcggtcacgcgtgacagtgcgtctgtggtagacaagtgatgaggacaaagggaaagcatctctgatttcgagattattcagagatgctttttttgtatttttgttctaatacgaagtcgatcataccgactatgcgggcgttttcggatttttgtttgaagcgttctgaaatttgaacttttcttgaaaatgggtaaacaccaaatacccatattaggccaattaacacaaaaaacatttgtacacccatttctattaaatcattataatgagaactgaaaaaataaatatataacgttattaatgttactgtaaatacgattttgacagtgtgtttgaatgtgagctgtggttcaattaaacacaatttcatttggttaagtgtgaaagagtcttgtttcattaggtacgaaagtaaatcattatcgttttgactgatagggtacaagtcagtttctattttttttgtgatctcctgatatttatgtatattacttttcatacagtatccccccttttttaagaagaactccatgaatccctacaggactcatggagaaacaatattatttaaaaagtgctaaaaatgtacggaagagtactgcagcagctcccatttcaggacctaccgttaatactaatgcaccaataccagcaacaattaagatacctgtacctaccacaagcatgttgttgacaatagtatcccaatctggtgagtatacttcctcagtatctggtaaagtaaagtgcttctgttttattttaaacgtaatcgtagtcgttagtccagttgtgatattgtcaccgactggaatatcaggtgtatagattttaatttgaatatttaaagattcagctgttggatttacataaacctccaaataaccgttgcgtactgataagctgagactatttaaaaggttttgataagagtcgatttgtgacgcagtaagagacgtttgagtgtcgcccaataaacccgtgatataggcacctggtttaccatttgtaatggtaattgtgtttggtgaaccttcacttggtatggttgccaaaagtgaagttgatagaataatatccaattcaggtgatgtgaaaatggtttctgtcgtatcaaattcaaacatcgcgtttgccaaacttgttagattttctaaagccggaatggtagataaaatgtctgtcagtgtacgcagccttgcatcatataccggatcagacggcggatttacattgcttgcacctgagtctcttcctgaaaatccgtctttatcaattccgatgcttccagaaccgcttccgatggttccttcataaaattgatcaaaggcccagttgtttggcataggatagccgagattgccgctaaatcctgttgacatatttgccacaaaactatactttgtcagttctgcttctgatgtacggatacaaatgtttcttggtccgtaaacccctatttcatacttaggtgcggttgaaaatgtctgcatttttgtaaatgctgacttaatctcttggaaataaggaatgattttatcggtcacttcataatcgtatgcatcaaaatcgacagcgaaataaatggtcgtgcctgacggaaaacctaatcttctagcaacagaagcggcactatatgcatctcttgtgccttggtctttgacaaaataagaagattcatagccgccgtcttgataaattgggaaaaccttcaatccggcatcaagaataactgcaagctctttagatgtcagggcttttgatgtgaggccgctgcttgtccgcacatttccggtcaaatatctgccaaccgttttataaccgttattccgcagtgtttgagctttttctgcggttataattgtagcagtgtcacaagcagaagcggcgcgagttgtgtctcctgagcttgataataaagctttaatggttggcatatctgcataacctgtttgcggcaggcacatgaactcttgaaatgctttaacagctgaaacaacacccacaccatatttgccgtcaaactcaccaggatcgaacgattttccgttacaatagagggcgtactgaacaattaagacaaatcctgttcttgaatcgccgggagttaaagtaggacacaaacttgtggtgccgtttccgaaaaatccattggcaacacttgtgctcatgccttcttctttttgcagggcataaataagagctttatttgtatcgcggccatacagtccgtcacaaggcattaacccgatatagtcattgtagtcccgatttaagttttgttgaatctggcgaattcttgaatcacccccagacaccagcttaaaagcgctcatgtctaataaggctttcataattaacgtggtgacaatcccatcctgtgttgtcagtccggcagctttttgaaattcttttaccgcattttctgttttttcgtaaaagacgcctgtaaaaccgccgggattaaagcctttacaccataaagccccttgtaaaataaaattcatgttgcttggttttgaatctggagcttggcgtttaagaggcttaaataagcgctgtgttgtcggcccgaagttatcggctggctctgagatacccaattcaatttgaagcgcccgagtcagaccgtagatcgtatcccacccagttttcccgctttcttcaactgggttatacccatgtttgccgctgtacgtatcgttcagccattgctgtgtgattaagaccatttcatcaaccatttcgattcctcctttgttagattgcgttcatttataggtggcaaacgtaggacaaaataaaaaaatggatgccgttaagcatccattttacatccgttctccaacagcttcgctttcggtttcagctctgaaatgtagaggcctaaaagtgtaagcgcgcctcctagaagagcgatccatgtcatgttttcgtgcagaatcaggacagaagcggcgatcgtgataaccgggaccatgtaaatatacgcactggatttgacggctccgagcacgccaactgaataattccaagtggcgaagcacagggcagaagcgccaattcctaagaaaagcatgttgagtatatttgaagcagatgaaaatcggcttaggtcaaaatggaagtcgaacaaaaataaagcgggaaccataaataataggccatacaaaaatactctctgtgtcaactcgatgatgtggtattcgtaagcgcttaattttttcatgaatatcgagtatccgccaaacacgagagcagccccggctgccatgatgtctccgagtggatttagacgcagtactacattgccgttaaacgtaatcaataaaagcccgatcagtgccgagacaaatccaatcaaaaaagtcagacgcagtttttcgccttcgagcagaaaatgggccaaaaccgcagtgatcatcggtataatggacacgatcatgccgacattggaggcgtatgtataggtgagagctatattttctaatagaaagtataaggttacgccaaataaaccagccccggcaaacaacagctcctgccgccaatttctgaacggaatcatgttggggcggacgaggataagagcgataaagcccatcaaaaaccgataaaataatatttccattggagagaagtcagccagcagaacttttgtcgaaataaaggtcgtcccccaaatcagaatggtcacaatggctgcgatatgccccgaagtttctctttgtatgttcatctgtgaagctccttttcaaaaatcttcatgtattgcttcggcgtcagccccacctgccgtttaaaaaacttcgtcatatggctctgatcgctgaatcctgtctgaaatgccgcatcaatcggccttaccccttgttcaagaagttttttggcttgattaatccggattgtttccatgtagctattaggagtaatgcctttttgttttgtaaatgaacgcaataaatgatacttgctccagcctgttaattcactcaaatcattgagtgtaacattttcggcataatgctcttctaaaaattcacaaaccattttgacttcgtctgatggttctggaacgctgctaaggaacgtgacatctgaataatggcggatcagctcttctaatagatgaagaaacagctcctccttacgcaaagcttgtttttcctcggatatcaaaatatgcaattcctgcaggctggctgtcagctcatggcggaataacacatgctgggagaaataagggagatgcccggcgccagtaatctctttcaccgccttctccatgatatccggcatgacattgatacaccgataatcaagcgtccggccgtcaatctgttcacagctatgcgtgtcacgggggttaaagaggagaagatcacctggattgatgatatattcttgatcctggcaggccagataccgttgccctttttcaataaatccaatcacataataatcgtgaaagtggttcgggaacttttgcataattcccttgaagcggtaggcttctatatgaaggtgtgggtcaagctgcagtgtgcgggtttcgttttgcatgggatgcctcctgtcggtgtggtggtcttggattaagtgtagcatgattttgggggatttcttgtatgatgttgctgtttaggaatagagaaagcagaccgttatttgtctgctttcgtttaagaatttaaaagattttaaccctcaataataattttatcttttttaataaaaatttatttttcaaatatttcagttataatggtttggaacagataggaggggcaaagatgtatcaatcaaagaaggttttattgttaggttcaggtgaattaggtaaagaggtagtgattgaagcccagcgtcttggggtacagacggtggcagttgacagttacgagcatgctccggcgatgcaggtcgcgcataacagttatgtcgttgatatgctggacccagagcagatcagaaccatcattgagaaagaaaatccggatttgattgtgcctgaggttgaggcgattgcgacggatgaattgctgaagcttgaagaggaaggatttcacgttatcccgaatgcccgtgcggccaagctgacgatggatcgggaaggcatcagacgacttgcggcggaaacgcttggacttgcgacagctggctatgaatttgcgaatacatatgatgaatttatacaagcggcagctcagatcggttttccttgtgtcgttaaaccattgatgagttcttctggaaaaggccaaagtgtgtgccgctctgaagcggatttagagagctgctgggagacggcgatggaaggcggacgggtgaaaaacggccgcgtgatcgttgaggagtttatccctttcgaatcagaaatcacactcttaaccgtacgtgcggttaacggtacggcattttgtgagccgatcggtcatgtgcaaaaggacggggattatatcgaatcgtggcagccgcatgatatgacagagcagcaaatagaagaagcgaagcatattgcgaaaacgatcacggatgagcttggcggatacggcctgtttggtgttgagctgttccttgcgaaagatagggtatatttcagtgaggtatctcctcgtccgcatgatacgggtcttgtcacgctggtgacgcaaaatttgtcagaatttgcgctgcatgtccgggcgattctcggctttccgattacagaaatcacacagctttctcctggcgccagcaggcccctcaaagcgccggaagaattagcggattacactgttgaaggattggaaaacgcactggcagtcccaaagactcaagtgcgcgtctttggaaagccgataacaaaagccggacgtcgtatggcagttgcgctttctgctgctgattcagttgaaacggcaagagagaatgcaaagaaagcgttggaccagctaattttaaaatagagtttgaacaggtcttgtcatgggacaaggcctgtttttttctttctccgtaaaagttttatcataagaatcagaaacctgattataatgtaaaagtcttccatcgatacgggtggttgacactaaaggagggagatgacaaaatgaaattagttccaagattcagaaaacaatggttcgcttacttaacggttttgtgtttggctttggcagcagcggtatcttttggcgtaccggcaaaagcggcagagaacccgcaaacttctgtatcgaataccggtaaagaagctgatgctacgaaaaaccaaacgtcaaaagcagatcaggtttccgccccttatgagggaaccggaaaaacaagtaaatcgttatacggcggccaaacggaactggaaaaaaacattcaaaccttacagccttcgagcattatcggaactgatgaacgcaccagaatctccagcacgacatcttttccatatagagcaaccgttcaactgtcaatcaagtatcccaacacttcaagcacttatggatgtaccggatttttagtcaatccaaatacagtcgtcacggctggacattgtgtgtacagccaggatcatggatgggcttcgacgataaccgccgcgccgggccgcaatggttcgtcatatccgtacggtacttattcaggcacgatgttttactccgtcaaaggatggacggaaagcaaagacaccaactatgattacggagctattaaattaaacggttctcctggaaacacggttggctggtacggctaccggactacaaacagcagcagtcccgtgggcctttcctcgtcagtgacaggattcccgtgtgacaaaacctttggcacgatgtggtctgatacaaagccgattcgctccgctgaaacgtataagctgacctatacaaccgatacgtacggctgccaaagcggctcgcctgtttatcgaaactacagtgatacagggcagacagctattgccattcacacgaacggaggatcgtcatataacttgggaacaagggtgacgaacgatgtattcaacaatattcaatattgggcaaatcaataaatacagcaaactagccatattcatgtctattttgtttttatgcgggtgcagttcgcagacgcattcttctcaaaaagaaacgactattcctgtcactcttcatgtggaggatgctaaggggctgccggtcgaaggggttcaagtgacgattgtcaaagcgccctcttcagatgaggagccgagtacagagattggcgagatactcggtaaaacagacaaaaacggagatatcaaatgggataccggcagaaaaggcgattactcagtcgcgttgacgaagggtgaaacatcagtaacccatcacatctcgttaacagaggataaaaaagatcatgccattccattagtcttcaaagaatagcagtttccttgattttaagggaactgccttttttatttattgcaggaaaccaaactatatactggaaatttattatgtgagataataagaaataggtattttttcttacgagacaaaaggggcgttatcctttatatcaatcaaacccggaggaaaaagaagaagatgatacaagattcaatgcagtttgccgcggttgaaagtggtctgcgcttttaccaggcatatgatcaaagcctttctttgtggccgattgagtcggaagcattctatgtttctactcgttttggaaaaacacatatcattgcaagtgggccaaaggacgcaccttcgctcattttgcttcacggaggccttttcagctctgcgatgtggtatccgaatatcgcagcgtggagcagtcaatttcgtacatatgcggtcgatataataggagacaaaaataaaagtataccatcagcagccatggaaacgagagctgattttgcagaatggatgaaagatgtctttgattctcttggacttgagacggcacatctggccggcctttcgcttggcgggtcccatatcgtgaatttcttactccgcgcgcctgaaagagtagagcgggcggttgttatcagtcccgctgaagcgtttatttcatttcatccggatgtctataaatacgctgcagagcttacaggggcaagaggagctgaatcatatatcaagtggatcacaggcgacagttatgatctgcatcctttactgcaaagacaaattgtggcgggcgtggaatggcaggatgagcaaaggagcctgaagccgacagaaaacggctttccgtacgtgttcacagaccaggaattgaaatcaatacaagtcccggtacttctgatgttcggtgagcacgaggctatgtaccatcagcaaatggcctttgagcgggcttcggtattggtgccgggaattcaggctgaaatcgtaaagaacgccggacatctgttatctctggagcagccagagtacgtcaatcaacgcgtcttgtcctttttatgcgggggataaaatagtaaggaacatgaaaagattggcattcatttttcaaaaggtaacaaatgttgtataataatagaatttgaatgctgctttttttgggagcattctatgttatcatgcttattggagaaaaatttttcctgtaacgctattcgatcactatcgtcaaataatatagatggttttacaattggaggtttggttacactgtgaattacatcccctgtatgattacgataggaaacttcatttgcggattgctggcgattcattccttgctatatcacaacattcattcagcagtgctttttatttttacaggcatgttccttgatttctttgacgggatggctgctcgtaagctgaatgccgtttctgatatggggagagaactggattcgtttgccgatctggttacgtttggggtggctccttctatgcttgcttacagtgtcgcgttgtataccctgccatttatcgggatcttatgcgcattgacgtacagcatttgcggaatgcttcgcctctctaaatttaacattgaacaaagcaagctcccgacgtttatcggtatgccgattccgtttgcgggcatgtgtctcgttattttaagcttcacctataacccgatccttctggcaatcggcacttgcggactctcatatttgatggtgagtaaaataaaattccctcattttaaaaaacatgcggcagaaaacctggagtctgggagatggaattagttcagcagctcatagcggattacggttatctcgctatttttttgatgctggtattaggaattgtaggattgccgattccagatgaagtgatgatgaccgttgttggctatttcacgcataccgatgtattgaattatgagctttcgatattgattagttttgtcggggctttgttaggtatgctgatcagctacatgattggcagaaaagccggacgcccgtttattgacaagtacggcaagtgggtcggcttaaaagaaaaaagaatgatgaaagtggaaaaatggatgaagaaatacggtccatattctcttattttaggttattttattcccggcgtcagacatgtgacgtgctacttttcggggatcggcaaaatggatctgaaaacgtatgttgcgtttgctgcaatcggcgcctttttatggtgctttgtttttattacaatcggaagggttatagggattattcatgtttaatacggctgtaaagattctgtatcgatcattgatagagctgacgaatcatcgtttgtcatcctatctgattaaaggattttgcgagtcgaaaatcagcaaaccggtcattccgcttttctcaaaacattttcggctgaattgggatgatgtggacggtacggctgctgattacggatcgctgtccgaattgttcattcgacaaataaatctggagcggcgccctgtgtcaaaagaggcgcatgcggtggtcagccctgttgacggtgtggttcagacggtaggaatcatcaacccgaatcaaacctttacggtgaagggaaaagattactcattcgctgagctgaccggctgtaaaagcgcagaccatcaatacaatggcggttacttcgtcgtgctgtatctaagcccgaggcattatcaccgtttccattctccgatcagctgcaggtatcaaaagctggccgagcttggaaatcgctcatacccggtaaatcaactaggcttaaaatacgggaaagatgtgctgtcgaaaaattaccggtttgtgtacgagctgaatagcggcagccgaaatctcctgatgattcctgtcggcgcgatgaatattaattctatcgtgcagacgaatacccgtactgaattggagatcggcgaagagctgggatacttttcatttggctcaacggtcattttgatttttgaaaaagacgcgttccagccgtccgcccatttagcagaaggccaagaagttcaagtcggagaactgataggttatgaagagtaaaaagaggagcttgcataaacgcagcgcctctttttttgaagaaaggtgagacttatggagaaacaaatcatcagctggattacagattatcagaacaccggagatgaagccgtcctgcggcaagtgcgagaagtgtgctggccgatcgttgaagcggttttgcatgagaaggcaatagatgatgaacaagcgaacaatttacgcgacaaaggaatcgagcggtttccattcatcatcagcaaataccaagcggatgtgcagcttccggttgagacatttttacgaaatacgtatcggttttactttcatcaggtgatgagagaatccagctaaagcttctttcaacagagaagcttttttttgttggcaggaaaaggaaactttttctatatctatctcgtaatgactagagaacctagcagaaaaggagagatagaattgaaacgaatgatagtgagaatgatcctgctgctgctgattgtctgtctggcgttttcttctttttcagtctcggcacgtgctgcttctgaagaaaaacattgggagcgctggattgaacgacatgcacagccactggatgcttccaatgcttcaaacaaagaccttcactttctgaagaaggtgctgaaaggaaaacgaatcgttcagttaggagaaacgacacatggcgctggcgaaatcaatgccacaaaggtcagaatgatcaaatacctccacgaagagctgggatacgatgtattggcctttgagtctggcttccctgatacaaatgcatcctaccttaatatggaccaattaacccctaaaagcacgatgaaaaactccatttacgctgtatggcacacagaagatgtcgttgaattgtttgattacatgaaagagcaaaaagagaaaggcgatccgctgatccttaccggttttgatattcaaagcatgaagaattcattcaatgatgctgcgactcattgggtaaaagcggtggaccctgagaaagcagagttgctctcccaatcagaaaatgatttttcaacattagtgacagacagcaatacgtttgatgaattttcgcaaaagaaggaaaagcttgtgaaaaactatcagaagctgatcaagttcactaaaacacatgcttcagagctaaaagaaaaccttccaaaagagccgaaagcttatgagatgtttatgcattctcttcagctgagaattgacgtaatggaaacgtatatgctggaagaaatgaaagaaaaactagaggagtatccggagaatattgaggatttttcattctttatgagagaccgcatgatggctgaacaatttcagtgggtagctgacaccctttatccgaaaaagaaaatcattgtctggggccacaattaccatctacgcaaacagaatacgaagatgataaaggactgggtacagctaaatggccctaacatgggtgattatttgccggagcggctgaaaaaacaaacatatacgattggcatttatgcttactcaggtgcgagtcttgatagctccgataataagactgttaagccggttacaagcccgccgccgtctgggagccttgaagctttgctgaaagcggcggaccgaccggctgtttttgttgattttctccatacaaaaaacaagaaaggcacttcgtggatgtataccccccgcacagcactctattggggattcacagaagagcagctgatccttaaggaacaatatgacggtgtcatttggctggagcatatcacaccatctgtcattatcaagtgagcggtgtcccctgtggtaaacaggggatttttacatatcgcaaaaataatcaaaacatataatccgtgatccattattctaaaacagaaaggagattggagcgtgcaatgtattatgaaaaagctgtccagaaaacaatcaattggattgaatcacatttacatgagcaaatatcaaacgaggatattgttaacgtttcaagcttttcaaaattccattttcatcggatttttcaaaaagaagtcggcatgtcggttgcttcttatattcggttaagacgtcttgcgaatgcggcggcagctttgctttatacagatcatcgtattatcgatattgctttgtattatcagtttgaatctcaagaagcatttacgaggacgttcaaaaagatgtatcacatgccgccaggagcataccgaacatttatgaaacgctttacttcaaaaaaggaggaatcttacatggagaaaaaaatgaaaggctgggtattgagcgggagccatccgttccaattcgaaatggggattgaccgggaaaatgtacatcagggaaaagcttcagggtatttaaagtcaacgatggttcaggatatcggtgaatttgcgacgatgatgcagcaattcaaagcagatcgctatctaggaaaaaggcttcgtctatcaagttttatcaaaacaaagggggtgcagcattttgcctcactttggatgcgggttgacagtgctgctgatgatgttctccaatttgataatatgagcaacagacctattaccggaacaaccaattggaatcattatgctatcgttttagatgtcccagaaaatagcgctgtgatatcttttggcgttcaattatctgggccgggtcaggtgtggatggatcatgttgtttttgaagaggtagatgagagcgttccttcaacaaaccttgaaatgccgggagaacttttagatgaaccggtaaatttatcttttgaagaggaactacaaaaatagttttcagacaactatttttattagtgagttattggaaaatactatttgttattaataaacccttgtgctgcttaggtttgtaagagcttggatatttttatcagtctgggcggatctgttcatctttgcggcattttcctgtatgatatagtaagagtgtgcatagcaactaactataattgaacagggtgtttaaaacatggaaaaacaatacagagtattactttactataaatatgttccgattgaagatccagaggcgtttagagagcagcatttggctttttgtaaggagcttggtttgttaggccgtatccttgtttcttctgaaggaattaacggtacggtatcaggtacggttgaacagactgaaaaatatatggaaacaatgaaagctgatcctcgttttgcggacatggtatttaaaattgatgaagcagaaggccatgccttcaaaaaaatcttcgtccgccataaaaaagagcttgtaacgcttcgtcttgaagatgatgtcgatccgaacgaaacaacaggccagcatttgaagcctgcagaattttatgagaagatgcaggatccaaacacaattgtcatcgacgcgcgtaacgattacgagtatgaccttggccatttcagaggtgcggtccgtcctgacatcgaagccttccgcgaattacctgaatggatcgaagaacacaaagatatgcttgaaggcaaaaagattttaacgtactgtacaggcggcgtacgctgtgaaaagttctcaggatggctggtgaagcaaggctttgaagatgtagcacagcttgaaggcggaatcgtgacatacggaaaagatccagaggtgcaaggcaagctttgggacggccagtgctacgtatttgatgaaagaatcagcgtgcctgtcaaccgtgttgagcatgtgattgtcggtaaggactactttacaggagaaccgtgtgagcgttatgtgaactgcgcaaatccatcttgcaataaaaaaatgatatgcacaccggaaaatgagtataaatatatgcgcagctgcagccacgaatgccgcacgaacccaagaaacctgtatgtgaaagagcataatatgacagaagaagaagtaaacgcaagactggcagcgattgaaacagaagatcacgctgctgctgaataaaaaaagaacacctcgtattgaggtgttctttttttctatatgctttcagtttggctgtttgcggaaacccattctttttggcggaaggccttttcccattttgataccacgatacaggcgatcgcatgtcccggtacgttcacgcccgttctcgccatgtccatgacgcggtcaacacccgcgataatggcaacgccttcagccggcagtcctacagcattggcagtcgccagaagaactacaagcgatcctgagggtacagctgcaatgcctttactggtcatcacaagcacaagcatcatgagcagctgctgggacaatgtcatgtctacttgaaaggcctgtgcgagaaagatacaagaaactgataaatataagctggagccgtcacagttcaatgacaagccggagggaacgacaaatgataccactcgtttgggacagccgtatttctccattctatccatcagctgagggagaatggtttcagtgctggtggtggaaaatgcaattaaaaacagatcccatatcattttcaatacttcgaaatacttaatctgaaagatgagaccgacaagcggaaagaggacaaagaggatcaggaacaggccaaggaatacggtgccaaccagcttaaacatagggaggaggagttcaatgccgtattggcctacagaagctgccatcagggctaacacgccgataggagcagtgaccatgacgatttgtgtgagcttgaacataatctgagcggtagattcaaagaacttcatcactggttcagaagctttgccgataccagcggcggcgacaccaaataaaatggcgaagaaaataacggcaagcaaatcatttctggccatgacatcaataatgtttgtagggataatatccaggatcatttgcttgaaatcaacaactttgtctgtgtagccggaaagttcatggatatctttttttgccaaatgggagaggtcaagcccgacacctggttttaagacattcgctaataaaagtccaagccctaataccaacgttgtaatcacttcgaaccaaatgatcgtcttgatgccgagactgcccatttttttcatgcttccgcttcctgctgctccaatgacaatggtagaaaatacaatcggcacaacaatcattttaatcaggcggataaatccatctccgacaggcctcagtgccatcccgaaatcaggaaaaaagtggccgatcaccgcaccgacagccaaagcgattaaaatttgaaacgcgattaattttttcaaatgaatccccctttagaacgatagaatgtaggcatattcatatcattcgtgattcaaatgcaaacaccttttttcaagttattttattttgacagcgctttcattatgttggcgaaaaagtcccccgcagcagggggacttttttacttcatttgaatgtgctttagatcttcttcagaggtatttgtgaaaataaccggtgttatggctgaagcggcatgctgcttgatgtaattgagatcaaaggtgagaagcagttcgccttgtttgacggcttgtccgcttgtgacatgtgcttcaaagccttccccattcagtttgacggtatcgatgccgacatgaatcaggatttcagtgccgccggcgctcataaagccgatggcgtgttttgtcggaaaaatcgagacgatctcgccgtccgcaggtgcaacgacttttccttctgatggtataatcgcaaatccctcgcccatcattttttctgaaaagacttgatcaggcacatcccctaaagagactgtttctcctttaatcggataaaaaaaggtctcaccggaatcgggcttctgcggtttgtcagttaccgtgtccagcgtggcggcggtggcagggacgcctccggccatgattgttttgatgtcgtcttttaaggcatcggacttggttccgaatattgcctggaagttgttgttgacctccagcacgcctactgcaccaagccgttttaattcatcctttctgacttgacttggctgatgaacggtcacacgaagccttgtgatacacgcatccaggttagcgatattttgctgtccgcccaaggcctgcaacacgtgaaaggcaagttggtcttttgcaactggagctttctcctcattctgaccgtcttcatctgtctcacggccgggcgttttcaaattccatttcagaatcgcaaatcggaacaaataataataaatgaaagcaaacacgatcccgacaggaatgacaacccagccgtttgtagacagtccgtagttcaagacgtagtcaattccgccgcctgagaacgtatagccgtggcggacatggaataaatcacaaacgacaaagatgacgccggcaagaatagagttaatcaaatagagcacgggcgcaacgaacaagaaagaaaactcaaccggctctgtaattccggtcagcatagatgtgagcgccgcagaaatcatcacgccggagatcatttttttcttttccggacgcgcggtatggataatggcaagagcaactgccggcagacagaaaatcatgtaagggaaatcccccatcataaagcgcccggctgtcgggtctcccgcgaaaaaccttgtcaggtctccggttacggtgttgcctgttgatgggtctgtgtattctcccatcataaaatagaaaggcgtataaaaaatatgatgcaggccaaaaggaatcagcaaacgatagatcgttgcataaaagaacaggccgactgttgaatcggcaattaaactgctggctgcgttaattccgttttggattagcggccaaacgaatgagaaaatgacgccgatcaccaatgaactgacggaagtaataatcgggacaaagcgttttccagagaaaaatccaaggaccggatgcagctcgattgatgaaaatcgcttatataaataggcggcgagaagcccgataatgattcctccgaaaacccccatatcaatcaggtgctcggctccttcatacggaggctgaaggccgagtaattttcccatattgtcgagggtgacggttaaaattaagtatccgatgacagctgcaagtccggctacaccttctccgccggctaatccgatcgcgacccccacggcgaaaatcagcgggagattatcgaatacaacgccgcccgcatcctttataatagggatgttcagtaaatccttgtctccgaaacggagcaaaagacctgctgccggcaggacggcaaccggagtcatcaacgcgcggccaagctgctgcagaatttgaaatgcctttttaaacatgacagtctccttttattgtgttatgagaatgatgcactctttaatttttgagctgctttataatcggcgataacggttacatgattgtgtttttgaagaatagaggctggtacatctgtcgtgacaggacattcagccatcttttgaatagcgtctgctttttcctcgccgcttgctaaaagcacaatatgtttgctgaattccatgatggttttaatgcccattgaaatcgcgagtctcggaaccagcaccggatcgccgccgaagaatctggcatttgcctgtatcgtgctttccgagagcttcacaacacgtgtccggtcttcaaaatcagatcccggttcattaaaaccgatatggccattggcgccgatgccgagaatttggacatcaatgcctcccgcctggcggatgagatcctcgtatactttgcattccgcctcaagctgcgggttgtctccttgcgggatatgaatatgatcaggctgcatattgatatgctgaaatagatgctcatgcataaagtggttataactttgcggatgagatggagagagaccagcgtattcatccaaattaaatgtagtaacctttgaaaaatcaatttcgcctgcctgatagtctgaaatcaactgcttatacaagccgaccggtgtgcttcctgttgccaggccgagaacggtatctttcttagcttgtatttgttctttaataatggcagcgcttaacttacagagttcttcgtagtgctcggcgattagaatcttcatgtgacaccccctcaaagagatagacaagcaccatatttgttatgaccaatttatgatacttgtcattacgaatttagcaccgcccttatcaaactgtcaatattaatttctgaaaatttgttataaaagaaggatacaaatctttcatattgggatggcaaatggtattatggtctcaatgaaaaagaacggattgcatacagaatggggagaatgaaatgacagctttatattctgtgatcaagtttaaaatcattgagttgattaaatcgggcaaatatcaggcgaatgatcagctgccgacggagagtgagttttgcgaacaatatgatgtcagcagaacaactgtgagactggcccttcagcagctggagcttgagggatatattaaaagaattcaaggaaaagggacatttgtatcggcggcaaaaatacaaacgccgattccgcataagattacgagctttgcagaacaaatgagaggccttcgttctgaatcaaaagtgcttgagcttgtggtgattcctgccgatcactccattgccgagcttttgaaaatgaaagagaatgaacctgtcaacaagcttgtcagagtcagatacgccgagggggaacctttgcagtatcatacctcatatattccctggaaggcggcaccggggctggcgcaggaggaatgcaccggctcgctgtttgagttgttaaggacaaaatacaatattgaaatcagcaggggcacggaatcgatcgaaccgattttaaccgatgaaacgatcagcggccacttattaaccaatgtcggagcgcctgcgtttttatcagaatcccttacctatgataaaaatgaagaagtggtggaatatgcgcaaattattacccggggagaccgaacgaaattcaccgtagaacagtcatatcattcataaagcaatgtgttttaagaagggaatggtggttctatgtttttatttacgaatggaaaagtgctgtggggagcagtgattgctgcattcatcctttcaattgtattttacccttttctgccgacgcagatgccgattcattatgatgttgcgaacagtccggatctgacggttaacaagctggcggggactgtgatgctgcctgttttgatggtggtgtttgcatgggcgcggaagatcaattggcaatttgtattcgcagtgtatattttgctgatttgccacattgtcgtcctttgtttagcgctctaaatcaaacagccagaataaaactggctgttttctttaatttcagcttcatctgacaatgaatgtggtgtataatagctgatgatcctaaagaatattctgaaatttatcggtgtggagcggcgtatcatgaaaggaagggctgtatgttttttgcagctttaaaaagactgaatatttaaacaattatatgaaaggtgtgctgatcagattgaataagcttattgaacgagaaaaaactgtatattataaggaaaagcccgacccgtcttccttggggtttggacaatattttacagattatatgtttgtgatggactacgaagagggaattggatggcatcatccaagaattgcaccgtacgcaccgcttacgctcgatccgtcttcatctgtttttcattacggccaggctgtttttgaaggattaaaagcatacagaacagaggatggcagggtgctcctgttccgtccggatcaaaatatcaaacggctgaacagatcgtgtgagcgcatgagcatgccccctttagacgaagagctggtgcttgaggcattgacacaattagttgagctggagaaagattgggttccaaagaaaaaaggaacgtcactgtatattcgtccttttgtcattgccacagaaccgagtctcggtgtgaaggcatccaggagctatacatttatgatcgtgctttcgcctgtcggctcctattatggcgacgatcagctgaagccggttagaatctatgtcgaagatgagtatgtgcgggcggtcaacggtggagtcgggtttgcaaaaacggctggaaactatgcagccagtcttcaggcacagcggaaagcgaatgagctgggctatgaccaggtgttgtggctggacgccattgaaaagaaatatgtggaagaagtagggagcatgaacatctttttcgtcataaacggggaagctgtcacacctgctttaagcggaagcattttaagcggggtgacacgtgcgtctgcgattgaactgattcgaagctggggcattccggttcgtgaagagagaatatcgattgatgaggtgtatgcggcctctgcacgcggagaattgacagaggtcttcggcacaggcacggcagcagtcgttacgcctgtcggtgaactcaacattcatggaaaaacggtgattgtaggcgacgggcaaatcggggacctctcgaaaaagctgtatgaaacgataacagatattcagcttggcaaggtgaagggcccgtttaactggacagtggaagtgtgaaaatcgaaaaagaacctgcctgaaggcaggttctttttattttgaataagtcatatcagcagccggctcgcttttgcggttttttacataatatattgcatagcaaatggccataaatggaacgccgcaatagagtgcgattctttgattcggatcaaaggcaatgccaacaacggaagccaggcataacaggaacgcagcaatcggcacgaacggatacaaaggggttctgtatttcaaatcagtaaccttgtttcccgcttcgatataacgttttctgaacatgaattgagaagcagcgattcccatccacacgacaacgacggcaaaaccggaaatcgacacgagcacaacgtatacagtgtctggcgcaaatacgctggacagcaacgacagaatgccgccgatcatgctgaacaccagcgcgttaaaaggggttccttttgacgtcagctttgcaaatgtcggatgaagcgttttttcttttgataaagaccacagcatccgggaagaagcgtagagtccggaattagccgctgacaggatcgctgtcaggataacaaagttcatgatatcggctgcgtatggtacaccaactctgtcaaaaacagcgacaaacgggcttttgatgacacctgcatcttgaatcggaatcagccctgacagcacaaaaattgttccgacaaagaagagtgagagacgccagaccgttgttttaatcgcttttggtatcgtcttgtcagggtcaacgctttcaccggctgcgattccgattagttccgttcccgaaaaggcaaaattgacggacagcatcgtcatcaaaatcgggacaaatccatttggaaaaagcccgccttccgcggtgaagttggacagcatcggagcggcttctccgcctttgatcggaatgatgccgaacatggcagagccgcctaaaagaataaataatacaatggctaatactttgatgctggaaaaccaaaattctgattcagcgaaaaacttgaccgaaaatgcgttaagcaagaaaatgaacagcgcaaagacggcactccacatccaaaccgatgtatgggggaaccagcgctgcattaacaggccggctgctgtgaattctgatcccaatgccacggtccatgttagccagtacagccaagcaaccgtaaatccggtgcccggccctatgtatttggctgcataggtgtgaaaggcgccggtcacaggcatggcgactgacagctcaccgaggcatagcatgaccagatagacgatgccggccccgactaagtaggcgagtatcgttccggccgggcctgcttgctgaatggtataacctgagcttaaaaacagcccggttccgatgacacctcccaaggaaagcataaagaggtgccggcttttcatacttctctgaaagtttgtctcattcttgttgtgggcagagttcatctttttccaactttctataagcgatttatttcctcctaataaaaaatctcatgtcaggaagtgacacgagactccggcgaaccggctttaagttagaatatacaaactattccgataagtcaagttgtttttaaagagcgggcccaagccgcaatttcttgaatatcttcgggttttgtccggcagcagccgccaatcagtctcgcccctttttcatgccaggtgcgggcgctcgccccgtaagattctgcgtatgctgcgccgttccacgtttttgtttccggatcatattgctcacctgaattcgggtagacaatgatcggttttgacgtgttcttttttaactcctctatcaaggaagggatatgctgaagcggcgtgcagttgatgccgagtgctgcaatttggcggtgttcatcaagccacgatgcgcagtcagctgcaggtgctccgtcactgatatgcaagccgtctttagcactgaagctgatccacgcatacgtttcaggaaattccttcaacagctgaacaatcgctttggcttcagtcagacacggaatcgtttcgcatgccaaaacatcagctccggcttcaatcagcgccttcatccggggacgatgaaattcaatcagttcatcttctggtattgcgtagttgccgcgatattcagacccgtctgcaagataagcgccataagggcctacagaagccgcaatgatcggctttggccgattcaaacggttctcttcaagcgaccaaaattcatcgcgtgcttcagctgcgatgctgacggacaactcgatgagccggcgtgcttccgcttcgctcagcccgcgtgcggcaaagccttcaaatgtagactgatagctggcggtgattgcacaatcggcgcctgctgcgaaataatcagtatgaacttgtttaatcagctccggctcttccatcaggatttttgccgaccacagactgtcgttcaaatcacagcccttgcgttcaagctcggtcgccatggcgccgtctagcacaataagcgggtatgtatctagtatgtgttggataggattcatagaatgtacctttctttcagatttttttgaaaaagatatgaaaatcgtaatggaggcttacgtgtttgtcaataaacgcaaaaagagaaaggtgttcagcccatatgtctgaacacccttttcttatgatatttgtttgttgtgcgtgtcagtctttgtgtctgaaaccggccagcactcaatgccattatggtttttgagcacatctttataaaagacaggatctttgcctgcttttttctggcgtgtatagtctttcagcgccgtaaaaacaacctttgatagtaagaaaatagcgattaaattcacgacgaccatcaaacccatgaacaaatcagcaagatcccagacgagctggactttggcaacacagccaaacacgatcattgccagcacgccgatacggtagacaaaaatcagttttttgcttttgttcaaaaagccgatattggtttcgccataataatagtttccaattagagcacagaatccgaataacaaaatcagaatggccagaaagcctgatgcccatgatccgacatgggagctgagggaggcttgtgtcaaggcgattccgctcagacccggagtatgataggcatccgaaaacaggatgataaaggcggtgcttgtacaaatgaccagtgtatctgtcagtacaccaaaagcttggatcagcccctgtttgacgggatggcttgttgtggcggtggcagcggcattcggtgcgcttcccattcccgcttcgtttgaaaagattccccgtctgacgccttgcatgagtgccgcgcccaaagccccgccggcggcctgatcaaaaccaaacgcatttttcacgattagcgcaagcacacttggcagctgcgtaatgttggtgaaaatgacgaaaaacgcaactccgatatacaggacagccaatacgacgacaatggattcagccagctttgcaatgcgcttgactccgccaaaaataatcgtgccgaatacagcaattaaaatgagtcccaatgtcaggcggtttgtgccaaacgcgttttcaaaggcaaggctgactgtattggattgaaccgagttgaagacgataccgaacgataaggtgattaacacagcgaacagcgcgcccatccaccttttgttcagccctttttccatgtaatacgccggcccgccgcggaagccgtttacatcttttactttataaatctgagccagtgtgctttccacaaagctggatgctgatccgataatggcgataatccacatccagaagattgcaccgggcccgccgagtgcaatggcgatggcaatgcccgtaatatttcccgttccgacacgggccgccatgctgatgcaaaaggcttgaaacggagaaatgctgttttttgaccgggaagcagcaccttctcttaataccctgaccatttctttcagcatgcgaacctgtaaaaacttaagcctgaacgtaaaatagattcccagagaaaggagcaaaacaattaatagctttgaccacaaaagatcatttgcaataccgacgatatgttccaggatttgctgcatacaatcacctcttttttcatatttaaaaaatgctgagctcccattcctgcgccatatgcttcagcagcataccgccagtgaggctgttgccgtattcatcaatggcaggcccgtaaatgccgatgccgcatccggattgaaaaggctgttctcttctggcgcttggaggcaccagcgccatgatgccgccggagacgccgcttttggccggcacgccgacaaacgccgcatatttgcctgaagcgttgtacatgccgcacgtcagcattaatgccttggctaattttgccacatcttttggaatcacctgctcgcgtcgaatcggatgatacccgtcatgagcaaggatcaggccgatcaacgcaatatcttctgtggtgctctccatagcgcattgcttcaagtacacctcaagtgtttcttctacgtcagcttctaaaaagtttgtttcttttaaatagtaggccagcgctctgttgcggtgggcggtttcccattcagaacggaatacttcctcatgaattctcggccgttttcctatcaaagtttccatcaccgagtaaagaaactcgagcttttcgtatgccgattctccgggaaggatcgaagcgatggtgagggcacccgcgttgatcatgggattgaagggctttcccggcttgttgatttcgagccgaatgattgaattaaaggcgtcgcctgtcggctcgacatctacgcggtccagcacatagggaatgccgcggctcatgcaggcggcaataaagctaatcacttttgaaatgctttgcagggtaaaagagacgttccagtcgccggcgtgtatcatcgttccatcaggctccaatacacagatgccgagctgtgaatcattgacttttcctaaagcggggatatagtttgcgctttgtccattggcggcaaaagggcgatagtattcaacccaatcatgaagctgtaacgccggatttatgtctttctggtgctcttttatcaattctttcatcgaattcctcctcactgatttttttcttaaaggactgaggtgtatcaaaacgaaggctaaaggggcgttaaacgctttcataatagcggaaggtataattactgtataatggagactacagaatcatacaaaatacgacaaaaacattttgaaaataagcagtaagatttataaaaacctcatgttctgggtcaaaagcaatttgcaggttttctcccgattccccaaaataaaaagcgaggatgtgatcaacataaaactggaacggtttattgaaaaagacggatatatactggccctcatgctaattacggtgccgctggccggtgaactgaaattttatcccctcaatgaagaattccgggtcagctttggggcaccggtttttttcttctttttatcgttgttgcggcatgtgcccgctgtgctgccgggttttctgactggagcggctgttttcatctttcgcgtctttctggaattatggggcggaggacacaatgggctgactccgattctgtatgatcaagcgtctggctttttcttttatatgacttacgcctgtctgttttccatattaaaggccaatcgtttccgtgaacggccgattatgctcggtttcattgggtttatgattgaagttgtgtcagattgtgtcgagctggctgtgcaatttctcatttttcatacggttgttacgcctgagaaaatcactgacattgcggtgattgcgatttctcacacatttattgtgatgagcttttatagtgtgctgaagctgtatgaaacacaatcgagagaaaaacagacaaggcagcagcacgagcacatgctgatgatcgtttccaatttatatgaagaaacggtgcacctaaaaaagacattgaaaacgacagagaaagtgacaaacgattcgtatcagctctatcgggaaatgaagggcaaggatgttcagctgagcggcagaatcctgagactggccggagagattcatgaagtgaaaaaggacaaccagcggatattcgcagggctttcaaaactgatttcgaatgagagtttgagagattatatgagggcttctgatttgctgcagctcgtgattcgaatgaatgaaaagtacgctgaagcactagggaagcagattgatttttactgctcgatcgagggagagcatgacgaatatcacgtatttatcgtgctttcgatcattaataatctaacagcaaatgcggtagaggctatggatgaagagggaatggtcagcctgaggctccgtaagccaaatgagagtatggtagaattccaggtggaagacaatggccccgggatttccgagaaaatcggagacattgtgtttgacccgggctttacttcaaaatatgacgaatttggcacgccttctacgggtatcggactttcctacgtaaaggaaatcgtgactgagctagaaggggatatcacgtttgataatcagcagcggggagtggtgtttgccatcaggctgcctgtccggcatttgattcagaaagggtgaaccgaaagctatgcgtttttttattgcagatgatgaccgtgcagtgcggtcaattttaaggcagatcattgaggacgaagatctcggggaagctgttggtgaagctgacgacggaagccaagtggaagggcatatgctgcaatttaagcagattgatattttattaatcgatctgttaatgcccggaagagacggcattgagacgattcgtcagatccagaatacgtactccggcaaaatcataatgatctctcaagtggaggcgaaggaaatggtcggggaagcgtactcgctcggcatcgaatattttatccataagccgattaaccgcattgaaattgtcacggttctccaaaaggtgaaggagcggattgagcttgaacactcgattggagccattcagcattctctaagccggcttgtcaatcggactgaacggaaagcgcgtccccagcagaagagtgacagcggtttaaaagaggcaggaacattcctgttgtccgagctgggcatgatgggagaaggcggcgcacatgatctcatggcggtcctgcagtatttagcagaacacgagcaatccgagccgcacgaaaaacaaagcccttcgctaaaacaaatattcacccaagtagcgctacggaagctgggcacaggggcctcacagacggaagtcaatcgcgaaatgaaagcctcggagcagcgtatccgcagagcgattattcattcgctgcaccattttgcttcactgggcacaactgatttttcgaatccaaaatttgaaacctatgcatccaaattctttgattttccggttgtcagccagaaaatgaaagaactccaatccaaggatgcaaaaccccttgcacctgctagaataaatatgaaaaaattcatccacgtgttttttttggaagcaaagcttttgcatgagacgatgaaacaaagaaggatataaaccaaacagccggctgaccaggctgtttttttgctgcgcagaatcccggccggacagtgattcaccgcttttttataaaatatcagaaaataaagatattgacttattgtttatttgtcttacaattaaacaaaaggatatatggggaaggagcggatgtgaaagaaaaattaataaaagcgcttacagatagaggctgtatacacaaataacaggaggttatgttgatgagccgtatcagaaaagcacccgctggaattttaggttttccggttgctccttttaacacacaaggaaaactggaggaagaagctctttttcaaaacattgagtttttgctgaatgagggcttggaagcgatatttatcgcttgcgggtctggtgaattccaatctctcagccagaaggaatatgagcaaatggtggaagtcgcagtctcggcagccggaggaaaggtgccggtctacacgggggtgggcggcaacctcagcacagcgcttgattgggcgcagctgtcggagaaaaaaggcgccgacggctacttgattctgcctccgtatttggtgcatggcgaacaggaggggctgtaccagtatgcgaaaacgattattgaaagcactgacttgaacgcaattctttatcagcgcgataacgccgttctctctgttgaacagatcaaacgtctgaccgaatgtgaacagcttgtcggtgtcaaagacggggtaggaaatatggatttgaatatcaacctcgtctatacgatcggcgaccgcttaggatggctcaacggaatgccgatggctgaagtgacgatgccggcttatctgccgatcgggttccactcttactcttcagcgatttcaaattatatcccgcatatttcgcgaatgttctatgatgcattgaaaaacggaaatgacgagcttgtgaaggaactctatcggcatgtgattctgccgatcaacgacattcgcaaacaacgaaaaggctacgccgtatccttgattaaagccggtatggaaatcatgggtttgaatgtaaggaatacagccagaccgcctgtcggcccggttgaaaaagatcattatcagcaattggaagcaattttgaagcaggcggctgaccgttttccgaaaaaagccgcgacggtttgaccagaaaaaacacgaaaggggcaatgggcatgtctgtgatcacggaacaaaacacgtatctcaactttattaacggagagtgggttaagtctcaatcaggcgatatggtcaaggtcgaaaaccctgccgatgtgaatgacattgtcggatatgtacagaattcaacggctgaagatgtggaacgtgccgtcgccgccgccaatgaagccaaaacggcttggagaaagctgacgggtgccgaacgcggccaatacttatacaaaacagcggatatcatggagcagcgcttggaggaaatcgccgcctgtgcaacgcgtgaaatgggtaaaacattgccggaagcgaagggagaaacagcccgtgggattgccattctgcgctattacgccggagagggcatgcgaaaaacgggtgacgtcattccgtctactgacaaagccgcgctcatgtttaccacccgtgttccgctcggtgtggtcggcgtgatttctccgtggaacttcccagtggcgattccgatttggaaaatggcgccggcattggtatacggcaataccgttgtcatcaaaccggcgacagaaacagctgtgacatgcgcgaagatcattgcctgctttgaggaagcggggctcccggcaggggtcatcaatttggtgacaggcccgggttctgttgtcggtcaggggcttgctgagcatgacggtgtaaacgccgttacgtttaccggttcaaatcaagtcggaaaaatcatcgggcaagccgctttagcgaggggagccaagtaccagcttgagatgggcggcaaaaaccctgtcatcgtagctgatgacgctgaccttgaagctgcggccgaagctgtcataacgggggccttccgttcaaccggccagaaatgcaccgcgacaagccgtgtcattgtacaaagcggaatttatgagcgctttaaagaaaaactgctccagcgcacaaaagatattacaatcggagacagcttaaaagaggatgtctggatgggaccgattgccagcaagaatcagcttgataactgcctgtcatacattgagaaaggcaaacaggagggggcttcccttttaataggaggagaaaagctggagaacggaaagtatcaaaacggctattatgttcagcctgccatctttgacaatgtgacatctgagatgacaattgcccaggaggaaattttcggtccggtgatcgccttgatcaaggtggactcgatggaagaggcgctgaacatcgccaatgatgtgaagttcggattaagtgcatccatcttcacggaaaacatcggccgaatgctttctttcattgatgaaatcgatgccgggctggttcggatcaatgcagaaagcgcaggtgttgagctgcaggcgccttttggcggcatgaagcagtcgagctcccactcccgagaacagggtgaggcagcgaaggactttttcacagcgatcaaaaccgtttttgtgaagccgtaatggtgctggaaagaggcatgcgtctctttcccagctttatcacagccagcatatgattctctactttgaaaaggagaagatactatgaaaaaagactttgcgaatgttacaccggcgggcaaaaaaacgtccgtgcgctggttcatcgtgtttatgctgtttcttgtgacctctattaactacgcggatcgagcgacgctttccatcaccggagattccgtccagcatgatttgggattggactcggtcgccatgggatatgtcttttctgcctttggctgggcctatgtcatcggacagcttccgggcggctggctgctggaccgttttggttcaaagactatcattgcgttaagcatctttttctggtcgttttttacgctgctgcaaggggcgattggctttttctccgccggcacagcgattatcctgctgtttgcactgcgttttctggttggtttatcagaagcgccttcatttcccggaaacggcagagttgttgcctcatggtttccaagctccgagcgcgggacagcttcagccttttttaattcagcacaatacttcgcaatcgtcattttttctcctttaatgggctggcttacccactctttcggctggcattccgttttcgttgtcatgggtattgcaggcattcttctggctgtcatctggctaaaaacggtgtatgaaccgaaaaaacatccgaaggttaatgaagctgagcttgcgtacatcgaacagggcggcgggctgatttccatggatgacagtaaaagcaaacaagaaacagaatcgaaatggccgtatatcaaacagctgttaacgaaccgcatgctgattggcgtgtacatcgcgcaatactgtattacgactctcacctatttctttctcacatggtttccggtatatttggttcaggcccgcggcatgtctattcttgaagctgggtttgtcgcttccctgccggcgctgtgcggatttgccggcggcgtccttgggggcattgtgtcagacatcttactcaaaaaaggccgttcactgacctttgcaagaaaagtgccaatcattgccggcatgctgctgtcttgcagtatgattgtctgtaactacacagattcagcatggctcgtcgttgtcattatgtcgctcgcgtttttcggaaaaggcttcggcgcattgggttgggctgtcgtgtcggacacgtctccgaaagaatgtgcaggattaagcggcggtttgttcaacactttcggcaatattgcctcgattacaacaccgattattatcggatacattgttaatgccactggatcttttaatggcgcgcttgtgtttgtcggcgctaacgcgattgcggcgatcctcagctatttgctgctggtcgggccgatcaaacgggtcgtgttaaagaaacaagaacaagaccccgatcaatcgttgcctgtctaatatttatgaaagcgctttataaagggaggaaaatgcatgagttcaccgatacaagagcaggttcaaaaagagaaaagatcgaatattccctcaattactgaaatgaaggtgattcctgttgcgggacatgacagcatgctgctgaatctaagcggagcacacagcccgttttttacccggaatatcgtaatcttaacggacagcagcggaaatcagggagtcggcgaggtgcctggcggagagcatattcggcgcacactggagctgtcagagccgcttgttgtcggaaaatctatcggtgcgtaccaagcgatattgcaaacggtcagaaagcagtttggcgatcaggacaggggagggcgaggaaaccagacgtttgatttgcgcaccactgtgcacgccgtcaccgcactggaagcggctttgttagatttgcttggaaagtttcttcaggaaccggtcgcggctttactgggcgaagggaagcagcgtgatgaagtaaaaatgctcggttacctcttttacatcggcgaccgaaagcggacgaccttgccgtatcaaagcgatgagcagtcagattgtgcgtggttccgtctgcgccatgaggaagcgctgacgccggaggccattgtgcgtcttgccgaatccgcacaagagcgctatggctttcaggatttcaagttgaaaggcggggtgctgcggggagaagaggaaatcgaagctgttaccgcattatcgaaacgttttccagaggcaaggatcactcttgatccgaacggggcatggtcattagaggaagctattgcattatgcaaaggaaagcaagatgtgctcgcgtatgcggaagatccgtgcggggatgagaatggctactccgctcgtgaagtaatggctgaattccgccgcgcgacagggcttccgactgcgacaaatatgattgcgactgactggcgggaaatgggtcacgcgattcagctccatgcggtcgatataccgctggctgatccgcatttttggacgatgcaagggtcggtgcgggttgcgcaaatgtgcaatgattggggtttgacatggggctcgcactccaacaaccactttgatatttcccttgcgatgtttacccatgtggcagcagcggctccggggcggatcacggcgattgatacccattggatctggcaggacgggcagcaattaacgaaacagccttttgagatttcttctggctgtgtcaaggtgccggataagcctggactaggcgtcgatattgatatggaacaagtggaaaaagcgcatgagatctaccggaaaatgaatttaggcgcacggaatgacgcgatcccaatgcagttcctgatccgcaactgggaatttgaccggaagcgcccgtgtcttgtgcgataagtttgtttgtaaatattgtcatatccgctattttgtcttacaattgaacaactgaagggagagttgttcgtgtacgaaggtttagaggatttgaaagtcgatacagtcaatcggaaaacattagccaagcaggtcatcgaacggattgtccatttattatcgagcggacagttgagggctggagacaaattgccgacagaaatggaactgatggacattttgcatgtcagcaggccggtgctacgggaagcactcagttcacttgaaacgctgggcgtcattacgagaaaaacacgagggggcacatatttcaacgataaaatcggcatgcagccattttccgtcatgcttgctttggccactgataatcttccggctatcattgaagcgcggatggcgctagaactcggactcgtgacaattgccgcggaaaaaatcaatgaggaagagcttcagcgtttgcagaagacgatcgacgatattgccaacagcactgacaatcattatggtgaagcggataaagagttccatcgaattattgcgttaagcgccaataaccccgtcgttgaagggatgattcagtccctgctgattacccatgcgaaaattgacagccaaattccgtacagggagagagatgtaacggtcgaatatcacaaaaaaatctacgacgcccttgccaaaagagatccgtacaaagcacattaccacatgtatgaacatctgaaatttgtccgtgacaaaattctaaaaggaatggatgaaaaataatggtgagcaaccgcagttgaaacgtaagagctgcggtttttttaaaaccaatttagaaaacgcttactaagttatgaggagtgattttcatatggcgatgaacctcaggaagaaccaagcgcccctttacatcaaagtgcatgaaatagataacaccgcgattattgtaaatgatggaggactgccaaagggcactgttttctcatgcggactcgtacttgaagaggatgttcctcaaggccataaggtggccctcaccgatctcaatcaaggggacgagatcgtgcgttacggagaggtgatcggatttgctgatgagacgatcaaacgcgggagctggatacgggaagacctcgtgagaatgcccgctcctccggcgttagacgatcttcctctcgcaaacagggtgccgcagccgcggccccttcttgaaggctacacgtttgaaggataccgaaatgcggatggcagtgcggggacaaaaaatatcctcggtatcacgacaagtgttcaatgtgttgttggcgttttggattatgcagtcaaacgaataaaagaagagctgctgccgaaatacccaaatgtcgatgacgttgtgccgctgcatcatcaatacggatgcggcgtggcgatcaatgcgcccgacgctgtcattccgatccgcacgattcaaaatcttgcgaagcatccgaacttcggcggagaagtaatggtcatcggattgggatgtgaaaagctcctcccggaaagaattgcctccgaaaatgatgatgacattctatcgcttcaggatcaccgaggttttgcggcgatgatccaatccattttggaaatggcggaggaacggttaatcaggctgaacagcagaacccgggtgtcatgccctgtttcggatctggttatcggcctgcaatgcggcggcagtgatgcgttttccggcgtgacggcgaaccctgccgtggggtatgcggctgatttattggttcgcgcaggtgcaacggttttgttttctgaagtgacagaggtgcgggatgccattcatttattaacgccgcgggctgtcagtgaagaggtcggacaatcactgatcaaagagatgaagtggtatgacagctatcttcggcggggagacgcagaccgaagcgcaaacccgtcaccaggcaataaaaaaggcggattatccaatgtggtggaaaaagcgttaggctcggtagcgaaatcaggcacaagccccatctccggcgtgctcggccctggtgaaagagcagagcaaaaaggcctgctgttcgcggcgacaccggcaagcgattttgtgtgcggcaccctgcagctggctgcgggcatgaatctgcaggtgtttacgacaggaaggggaacaccatacggcctggctgctgcgccggtgctgaaagtatcgacgcggcattccttatcagaacattgggctgatttaatcgatatcaatgccggccaaatcgcgacaggagaggccagtatcgaagacgtaggctgggaaatcttcagaacgattttggatgtggcaagcggccgaaaacaaacgtgggcagaccgttggggccttcataatgatttgtgcttgtttaatcctgctccagtgacttgattcatttttttatagcgattagatggaatatgatgtaaaatacaattaacgtataggaaacggaggggttacagcatggcattcattagattccgagtgacacgaattcaatagtgagcaactctcgcctgaatgcgggagaatcgggatgaatccgcctatgtatgagcccttatatggttattaaaaaagagggtggcgatgcctgccttcttttttctgcctccaaacatcccctctctctccttcagggcggagcatgagaaaggggaaatgggatgacaaaccttaccgaaaaacagatgatcacggagattgtcgggcttgcacgcagccaaggtttgacggttcattctgaggacgcgcaattgaatgaaaccggaatggactttcaagttgtatttgccaaggacgacacaggtatgccatgggtgctgcgaaaaccgcggcgaagtgatgttgtggaaagagcatctgcagaaggcataacgcttgcctttctccgcgcgaatctgactgctgatgtgccggattggagaattcacacgccggaattgatcgcttacccaatgttaaaaggaacgccggcggccgggattgatttggaacaaaagcaatatgtttggaatatgaatcatcagccgccatcagacgattttgtccgtacacttgctggcatactggctgaattacatggcacggatcaaatatctgctgggcaatccggaatagaagtgataaggccagaagatttcaggcaaatgacagcagactctatggttgatgtgaagaataagcttggcgtatctacgacgctttgggaaagatggcaaaagtggatagatgatgatgcatactggccgggtttctcttctttgatacacggcgatctccacccgccgcatatccttatcgatcaaaatggacgtgtcacaggacttctggattggacagaagcgaaggttgctgacccagccaaggattttgttctttatcaaaccattttcggagaaaaagaaactgcccgtttgcttgaatactatgatcaagcaggcggccgaatatgggcaaaaatgcaggaacacatttcagagatgcaggcggcgtatccggtggaaatcgccaagctagctctgcaaacacagcaggaggaacacatcaatatggcgctggaagcacttggtgtaacatcggattaagaattgacttcgtttcatgaaccgagtattataaactctacaaataatagaacggattaacaatcgtgaggaagagcaagtacgcatcagaatggaggttcagagagtcggtggcaggtgtgaaccgatcctcccctgatgccgaatgggcttctgaattgctttgctgaacggatagtaggcgatgccgggtttctctccccgttaccaagagaggagtatcgaaacataggttttctgtacttagagtgaacggctgtatagctgttaataaaggtggtaccgcgagaccctcgtcctttgcataggacgggggttttttgtgtttcttaaaggaggtgacggccaatggacgatggctggtggtggcatagcagatgagttagaaaggaggatatcaaatggtcattgcaactgatgatcttgaggtcgcatgtcctaaatgtgaaagagcgggagaaatcgaaggaacaccttgcccggcctgcagcggaaaaggtgttattctgactgctcaaggatatacgcttctggattttatccaaaagcatttgaataagtaaaggagaaaagctgagctgagatgagagcagaagagcagagtaagattcgtgaggccgcagcaggtacgatttttttgctgatcggaacagtttgttttgcgtctaaatcgatttggataaaatgggcataccaaatgggtgctgagccagatgccgtgctgctatataggcagctgctggctgttccgctgttttggctgatttttttaatatatcgtcctccaatgccagacggtaagaaaaaaggagacctatggaaggcttgtggcgcgggagtgttttgtttttttctgtctcccttgcttgattttatcgggctgaaccatgtatccgcaatggttgaacgtatattgctgatgagctatccgttgtttgtgtttggattcaccgcgtgtcgtgaccggaaaatgtcctcaattcaggaccttttcgcagttctggcggtcatgtttgggcttttcttggcgctgggcggctggaatgctgagcttttccaggcgaatatgattggagctgtattcattttgttatcttcggccgtctatgctggttatcttgtcctttccgggcatctcgtccatcaaatcggggggatccgtctcaatgcatacgggatgacagctgctggagctgccatgatgctttacacagggatcaaatcggcggctggcatgaatacgccaatggcagcatatccgctttctatgtatggtttgttcgcggtaattgcagtcgttaccacagtgattccatttgtgctaatgcttgagggcataaaacgaatcggggcacagcgagccgccgccatttcaatggcagggcctatcctgacgattttctatggagctttatttctcggtgaacggctcgggctcattcaagtcattggatgcggtgccgtattttttgtcattacggtgatggaatacaggaagctgaaaacaggaaaataagaataatttatataaaacacacacgtttttcaattacaataagtgtaattacgtgtgtgttttttgattttgtaaaggttaggtgagaagatgcagcgcatattgcttgtagaagacgaccactcaatcagtgaaatggtggatcattatttaacaaaagaaggctttggaattgtgcatgctttcgacggagaagagggcatccggctgtttcagcagggttcatacgatttggtcctccttgatatcatgctcccgaagctgaacggcatggattttctgaaaatcatccgggaaaaaagcaatataccggtcttaatgatttcggcaaaagacggagatgtggacaaggcattgggactgggttttggggcggatgatatcgccaaaccgttttcgatgattgagctgacagccagagtaaaagccgcgatacggcgggcgacgcaatattcggcagaggagccggctgtgaataaggtgatccggattcaccagcttgcgatagatatagacaatgtttccgttttgaaaaacggagagccgctccagctgacgtcaacagaatggcagctgctgtgcttatttgcatcaaatcctaaaaaagtgtttacgaaagaacaaatctaccgttccgtttggaatgaagagtactttgatgatcagaacatcattaacgtacatatgcggcggctcagagaaaagattgaggatgacccctcctcccctcaatatattaaaacgctatggggcatcggttataaattaggagagttttagaatgacagtgctatgggtggccgctgtcatcgctctggcgtgtctgaatgtgattcaattcataatgaaaaagaagcgggacgggaatctggcttacacggctgaccagcttagctacatgctcagccgggattcggcaggacaaattttgcttcctacagacgatcatgcgctcaaaggcttgcttgttaacatcaatcttatcgttgagaatcgtcagcagatcagcgctcgatttgccaaaacagagcaatccatgaagcggatgctgaccaatatgtcgcacgacctgaaaacgccgttaacggtcattctcggttatatcgaagccattcaaagtgacccgaacatgccggacgaagagcgggaaagattgctggggaagctccgccagaaaacaaatgaactcattcagatgatcaactccttttttgatttagcgaaattagaatctgaagataaagagatcccgattaccaaagtacatatgaacgacatatgcaaacgaaatatcctgcactattatgacgctgttcagtcaaaaggctttcaagcagccatcgatataccggatacgccggtgtatgcgcaggcgaatgaagaggcactggacagaatcctacaaaacctattatccaatgcgattcaatatggcgcggttggcaagttaatcggcatgacgctgtcttatgatgagaggaacatcgccatcaccgtatgggatcgcggaaaagggattagtgaaaccgatcagcagcgggtgtttgagaggctgtacacacttgaagaatccagaaataaagcatttcaaggaagcggcctgggtttaaccatcacaaaacggcttacagaaaaaatgggaggcaccatatccgtccaaagcaagccgtacgaacggactgcatttacgatcacattgaaacgcatgacatattaatcgtaagaatttcttaaggtttgagaaataaaaatgacagggctcgccgctacaatagaaaacaggaaaagagagggaaggagaaacaaagttgacttatatcgtacaaacaaacgggctgaccaaaacgtatcagggcaaagaggtcgtatccaatgtcagcatgcatattaaaaaaggtgaaatctacggctttctcggcccgaacggcgcggggaaaacaaccattatgaaaatgctaacgagccttgtcaaaccgacaagcggtgaaatcatcatccttgggaacaagttcacccacacgtcatatgaggtgctggggaacatcggcagcatgattgaatatccgattttttatgaaaacctgacagctgaagaaaatttagatctgcattgtgaatatatgggataccacaataaaaaagccatacaagaagtgctggatatggtgaatttaaaacaaatcgacaaaaaacccgtcaaaaccttttccctcgggatgaagcagcgccttggaattgcgcgtgccatcctcacgaagccggacctgctcattctggatgagccggtgaatggtcttgaccctatcggcattaaaaagatcaggcaattgtttcaagtgctgagcaaagagtacgggatgacgctgctgatctcaagccacctgctgggtgaaatcgaacaaatcgcggacacaatcggcgtcattcgggacggcaggctgcttgaagaggtatcaatggaggatgtcaggggccagaacactgaatacatcgagcttgttacgccgaatcagacaagggcctgctttgtgctggagaaagagctgcaattaaccaactttaaaattttaaatgagaaaacaatccgaatttacgaggctgaagcctctcaggctgccatatccaaagcattgattttaaatgatgtagacattgaatcaatgaacaaaaagtatacgtcgctggaggattattttatcaaattgatcaacggcaatagcatcagtgcgtaaaggaggagagacacgttgatgaatttgatcagaatcgaattaagaaaaatgaaaatgggctggtatatgagaggtgccctcattgccaacgtgatcattatgggttttatgtggctgatcagttattccgaaaaagccgatggcggggtttcgttccaaagtacggatgaagcattcctcatcatcggcaccttcgtcagagcggtatttatcgtatttggcgctgtgctgatcgtaaaattggtgatttcggaatataaaaacaaaaccattcttgtgatgttcacgtacccgatcagccgtaaaaagctgctcaccgctaagctcatgatcgcgggcggactgacgtttatcacgattttactttcaaatatactcatagccgccggtttcttttggctgaactcgatctgccatttcataccgggagagcttacttccgagatcatttctcaacaggcggtcaaaatggcggttttcgcttttggcgccgctggaaccagtttagttcccatcttttttgggatgcgtagacactcggttccggcgaccatcatttcatctgtagtaattgtgatgctcatcagctcaacaagtccgggcttctcgatttcatctgttgtgtatatcccgttatcgttagcggcattcggattgttcttttcctacatggcgatcaggaatgcggacaagcaggatgcgtaaacaaaagcgcccaatatgtataaaaggccgatgctgtcagcatcggcctttccattatgagtctgttcttgtttcaagataatgcttcttgccaatctctttgctcatcatatagaaatggaagcaatattcaccgattgccatgacgatcgcgccgaataaagccgccaacgcaacttcaccgccagtcatccctagggaaagcggcatgcccatcagccagatcacaagaaaggccaagccaaaatcagccaaagttgcaatcatattattccatctcggcaatacataaagatcgcccagcaaataagaaataacccctaacacaatcgtcattagcagcgtatcaccaaacgtgaaaccaaagcccagaccaagcaccagatacaacacaataatcgtcataatacctttaatcgcgagcgctttcacatgtgtcattacaattcctccttttgtcatttgatttgttatgtataattcctcaaatgtaaaaagttaaaccttatttcttttcggaggcgggtgcaaatctgctggggaggggtcaatgatgtgaatccaggaattgaggctgcggcgcttcgacagcggaaacgtgaagcttgtactgcaccggacgctgctttgatgcccaacagcccattatgtttgctgtttttagatgaataaatttaaaaacttctcctgtccctccgtcatcacttctgaagtaatgaaatatgatgaaaagagatcaaggggaggtgacgtgatggcggtcgtgagagcaacgagtgcggatgtcgatttgatggcaaggctgctcagagcggaagcggaaggcgaaggcaagcaggggatgctgcttgtcggcaacgttggaattaatcggctgcgggcgaattgctcagattttaaaggcctccgcaccatcaggcagatgatttatcagccacacgcgtttgaggctgtgactcatggatatttttatcaaagggcgcgagatagcgagcgtgcccttgcacgccggtcgattaatggtgaaaggcgctggccggcaaaatttagtttgtggtacttcaggccggagggagactgtccagcccagtggtataaccagccgtttgtggccagatttaagtcacactgcttttatcagccgacggcggagacgtgtgaaaatgtatataacacattttagagacaggacaccgttcaaattgaacggtgtttttatttgaaaagatgcaatggaaaatattcctgtgagataatcgaagaaaaaagagctgacggagatgacagaatggcaacaattgacctgcaaaagaaaagtgtaaagatcgtactggagaaaaagcagttaacgaaggtgacggctcgtgtcggactggttcttgatattacgggatcgatgagaccgctctacaaaaacgggacggttcaaaatgtggtggagcggattttggcagtggctgatcagtttgatgataacggtttgctggatgtatgggtgtatgataatgaattttcccgattaaagccagtttcagaaaaggatttttcgggctatgtcgatcgtgaaattttaaataatgaccgcttgcataaattcggcagaaatgatgagtcgccagtcatgaaggacgtgctgcgcaaatatgttacggaggaaccgagctcgtatcctgctttcattgtttttatcaatgacgggggctgtaaaaagtcaatcaaaccgataattgaagcttcttctgataaaccggtgttctggcagtttgtcggcatcggaaacggaaactttgattttctcaataaactggatacgttagaagggcgtgtcattgataacacgaacttcctgcatatcgaagagattgaccgcatttctgatgatgagctttatgatgctctgcttgctgaatttccattttggctgaaagaagcgaaggaaaaagggattgtaagagaacaagagcctcctgctgaaaagccgaaaaagaagggctttttcagcagattgttttcgaaataactgataaggcactgagccattctgcgaaatggctcggtgtttttgtttttttaagatcatgtgaagaaaaatagtccaaatgggcggcttgcaaacgacaggatatgcagaaaacgcgtcattcagccagctttcggcatgttttagcggcaggcttgtgagggaagacctgtttttgatgttcagcgcttacaatcagttcacacttcttcacagtcgtttaacaatgatttcctataatggagacgatcaatgaggagagaggggatcttgaatggcatacgacagtcgttttgatgaatgggtacagaaactgaaagaggaaagctttcaaaacaatacgtttgaccgccgtaaatttattcaaggagcggggaagattgcaggactttctcttggattaacgattgcccagtcggttggggcctttgaagtaaatgctgcgcctaaattctcaagctatccgtttacattaggggtagcgtcaggtgatccgctttctgacagtgtcgtgctctggacgcgcctggcacctgatccgctgaatggcgggggaatgccgaagcaagcagtgcctgtcaaatgggaggtcgcaaaggatgagcatttccgcaaaatcgtaagaaaaggcactgaaatggctaaaccgagtcttgcccattccgttcatgtggaagcggacgggcttgagccaaacaaagtgtactattaccgtttcaaaaccggccatgaactaagccctgtcggaaaaacaaaaacactgcctgcccctggcgccaatgtgccgcaaatgacctttgcatttgcttcctgccagcaatatgagcacggatattatacggcctacaagcatatggcaaaggaaaagcttgatcttgtcttccatctcggtgattacatatatgaatacggcccaaatgaatatgtatcaaaaacaggcaatgtccgcacgcacaacagcgcggaaatcattacgctgcaagactatcggaaccgtcacgctcaataccgttctgacgccaatcttaaagctgcacatgcggcattcccttgggttgtaacttgggatgaccatgaagttgaaaacaactatgccaataaaatacctgaaaaaggacagtcggttgaagcattcgtgctccgccgcgcggcagcataccaggcatactatgaacatatgccgctccgcatttcctctttgccgaatggcccagatatgcagctgtaccggcactttacgtacggaaacctggcgtccttcaatgtgcttgatacccgccagtacagggacgaccaagccaataacgacggcaataagccgccttctgatgaatcgcgcaatccgaatcggaccctgcttggaaaagaacaggagcagtggctcttcaacaatttgggcagctcgactgcccactggaatgtgctggcgcagcagattttctttgccaagtggaatttcgggacaagcgcaagcccgatctacagcatggattcgtgggacggctacccggctcagcgcgaacgggtgatcaatttcattaaaagcaaaaatctgaataatgttgtcgtactgacaggtgatgtacacgcaagctgggcatcgaatttgcatgtcgatttcgagaagacaagttcaaaaatattcggagccgaatttgtcggaacctcgatcacatccggaggaaacggcgccgataagcgggcggatacggaccaaattttaaaagaaaatccgcacatcaagttctttaacgactatcgcggatatgtccgctgtacagtgacgcctcaccagtggaaagccgattatcgggtgatgccgtttgtgaccgagccgggcgcagccatttccacgcgggcttcattcgtttaccagaaagaccaaactgggttgagaaaggtatcatccacaacaatccaaggcggggtgaagcaatccgatgaggtcgaagaggatcgtttctttgcgcacaacaaagcccacgaaaaacaaatgattaagaagcgggcaaaaatcacgaattaaggagtggaaattatgttttcaaacattggaataccgggcttgattctgatcttcgtcatcgccctcattatttttggcccttccaagctgccggaaatcgggcgtgccgccggacggacactgctggaatttaaaagcgccacaaaatcacttgtgtctggtgatgaaaaagaagagaaatcagctgagctgacagcggtaaagcaggacaaaaacgcgggctgaatgctgatgaggcagacaccgggtctgcctctttttttatgaaagggagggcttttttgaatggataaaaaagaaacccatttgatcgggcatttagaagagcttcgccgccggattatcgtaaccctcgcggcattttttctatttctcatcacggcttttttgttcgtacaggacatttatgactggctaatcagggatttggatggaaagctggctgtgcttgggccgagtgaaatcctctgggtgtatatgatgctttccggcatttgtgccattgcggcttctatccctgttgccgcgtaccagctgtggcgtttcgttgcaccggcgctgacgaaaacggagcgcaaggtgacgctcatgtacataccaggtttatttgcgttgtttttggcgggcatctccttcggatactttgtcttgtttccgatcgtgctcagctttttgactcatttatcctccggccactttgaaacgatgtttacggctgaccgctactttcggtttatggtgaatttgagcctgccgttcggcttcttgtttgagatgcccttggtggtgatgtttttaacaaggctgggcatcttaaatccttacagactggccaaagcgagaaagctgtcctattttctgctgattgtcgtatctatattgattacaccgcctgattttatttctgattttctcgtgatgatcccgcttcttgtcctgtttgaagtgagtgtcaccctatcggcgtttgtctacaaaaagaggctgagggaagaaacagcggcggccgcttagtgcagcgtaccgcccggtgacttcacatcctcatcatattgtgcggccgtaacagcggcgattctcaatgcccggacaatcgtgtccaggctgaggctcggcgctgttttgtcgattgtttgctgcggaatgtaaggaatatgaataaaaccgccgcgaatgtgcggggatgtccggctaatgtgatccattaacccgtagaacaaatagttgcatacaaaggtccccgctgtgtaggaaaccgcagctggaatgccgtgttccttcatcttagcagttattcgtttcacgggaagccctgtccagtaagcggcgggcccatctggagaaatctcttcatcaatcggctgatgtccttcgttatcggggattcgcgcatctgcaaggttgatcgccacccgttccggtgtaatctgcatccgtcctcctgcttggccgacacaaatcacgatatctggctgatgtgtttgaatggcttggcgcagagtgcccagagcggatctaaagacggttggaatttgttccgctgtaataatggcttcttccgtctcgaagccattaagccgtttcgccgcttcccatgatggattgacggtttctttgtcaaaagggtcaaaaccagtgatcagcactttttttctcatcttctcatctcctttttcttttattctattgtttatttatgggtttttcatcaaaataatgtaaaggagtgaatcataatggagcatttaccgcagcagtatcgtcatttattcccaaccttgcagacgcatacgatgcttgccagctgttctcagagcgcattggcagagcctgtatcaagggcgatccaggattatcatgacagcctgctgtataaagggacgaactggaaagaagcgattgaaaaaacagagtttgcgagaaacgagtttgcaaagctgatcggggctgaaccggatgaagtggcgattgtgccgtcagtttctgatgcactggtttctgtagcatcgtccttaactgcatttggaaagaagcacgttgtatatacagatatggattttccggcggtgcctcatgtttggcaggcacactccgattataccgtatccgtcattccatcaatagacggcgtgctgccgcttgaacaatatgaaacgcatatttcggatgaaacagtactgacgtgtgttcctcacgttcattatcgtgacggctatgttcaggatataaaagcgattgccgagatttctcagagaaagggctctttattgtttgtagatgcttatcaatcagccgggcatattcccattgatgtgaaggaatggggcgtagatatgctggcagcaggcacccggaagtatttgctcggcataccgggtgtggcgtttctttatgtgagaaaggagctggctgacgcactgaaaccgaaagcatcagcttggttcggcagagagaacggatttgatggggcttatgcgaaaggcgcgcgtcgttttcaaacgggcaccccagcttttatcagcgtatacgcagctgcagcggctttatcgctgctgaatcatattggggtttctcatatcagggatcatgtgaaaacgatctgtgccgatgcagttcaatatgccgctgaaaaaggcctgcagctggcggcggcacaaggtgggggtcagccgggcatggttgcgatccgggatgagcgggcatcggaaacggcggcgttgctgaagaagaaaaaagtgatttgcgcgccgcgggaaaatgtgatccgtctcgctccccatttttataatacgaaggaggaaatgcggcgcgcgattgatgaaatcgcggcgaaaacgatccacaagtaaacataaaaaaagcccctgaacattagtcaggggcttttcatattaatgatctaccttcacgcgcttcataaagaaagcgccaattaaaccgataatggcaacaatcattgcaaacacaaatgcgtgctgtacacccgctgtcaaagcttgcgggatgactgccggatcggcagggtttttaactgtactcatataatcatgctggcctgcagccataatgctgaccgcaaccgctgttccgatagcgccagccatttgctgcagcgtgttcataatggcggtgccgtctggataaaattcgcgcggcagttggtttaaaccgtttgtctgtgcaggcatcatgatcatagaaatcccgatcatcaagcaggtgtgcaggatgataatcagcacagctgttgaagtggtcgtgacatttgagaagaaccatagtacaacggtgacaatcacaaatcccggaatgacaagccatttcggcccgtatttatcgaacaagcggcctgtaacaggggacataaatccatttaaaataccgcccggcaagagaacaagaccagatgcaaatgcagtgaggactaagccgccttgcagatacatcggcagaagcagcatagatgacagaatgaccatcatacaaatgaacaccatgatcacacccaaaataaacatcgggtatttgaacgcacggaggttcatcatcggctgcttcattgtcagctggcggattgaaaataggataaggccgacaacgccgacaatcagcgacacgataacagtcgggctggaccatcccccggagccttcacccgcgttgctgaatccgaacacaatgccgccgaagccaatcgtcgacaggatgatagacaatacatcgattttcggctttgtcgtttcagatacattctgcatatatgcgataccgaaaacaagcgccagcacaaggaatggaagagagatccagaaaatccagtgccagttgagatgctccagaaccaatcctgagaaagtcgggccgatggcgggcgcgaacataatgacaagcccgatcgttcccattgcggcgccccgtttatgaggcgggaaaatcaccaagattgtgttaaacatcagcggcagtaaaagaccggttccaagtgcctgaacgatccttgccgccaataaaaacgggaagcttggcgcgagtgccgcgatcaaggttcctataattgaaaagattagtgacacggtaaaaagctgtcttgttgtgaaccactgcaacagcagtcctgaaacaggaacaaggataccgagtacaagcaggtagcccgtcgttaaccattggacggttgccgctgtaatgttcaattccttcataaggtcggttaacgcaatattcagtgctgtttcactgaacatgccgataaaaccggccaacagcaaggaaatcataatcggcatcactttgtattgctgagatgctttagctgttgtttccaaaatcatttcccctctctatcaactgcatgtagtatgtcgtttttttatctcttcagcaggtcaggaatgcagctggagatatgaaggagcggcgtactgttttttgccgtcaaagataaaagaatgccgccttcaatcatcgcgttaaccacagtgctggcttcttttgcacggttctcgctgcagccagtctgccgcagtttttcctcatatacagaggcccattctttgtaggcttcatgacaggcttcgcgcaacggttcgcttttcaatgacgtctcagccgctagcaagcccacaggcaagccttcaatgtcttccgtacatgaaaactggcaggagagctccttcaaaaaggcttgaatgccttccgctggatcggtgcaggcttccatgcagtccgcgattttctgacggatatactccttcatctcattcacggcttcgatcgcaagctgttctttacccccgggaaagtggtagtaaagagagcctttaggcgcgccgctttcctttataatctggttcagccccgtgccgtaatacccttgcagctgaaaaagccgggtagctgccgaaaggattttctcacgggaatctccataactcataacattcccaccttactgaattgcaatcaaaaatatagtgactggtctattatcttgattcaatcatcaattgtcaagaaaaattcattgtatgaaaagacaaaaaaagaaggatatgacaacaaaaaatactgagagaaaagctgactgatcttttgactgaatagataaaatgtacaatgattaatcatcatatggatgtaaggagagaaatagatgaaaaaacaacgaatgctcgtactttttaccgcactattgtttgtttttaccggatgttcacattctcctgaaacaaaagaatccccgaaagaaaaaacgcagacacaaaaagtctcttcggcttctgcctctgaaaaaaaggatctgccaaacattaaaattttagcgacaggaggcacgatagctggtgccgatcaatcgaaaacctcaacaactgaatataaagcaggtgttgtcggcgttgaatcactgatcgaggcagttccagaaatgaaggacattgcaaacgtcagcggcgagcagattgttaacgtcggcagcacaaatattgataataaaatattgctgaagctggcgaaacgcatcaacgacttgctcgcttcagatgatgtagacggaatcgtcgtgactcatggaacagatacattggaggaaaccgcttattttttgaatcttaccgtgaaaagtgataaaccggttgttattgtcggttcgatgagaccttccacagccatcagcgctgatgggccttctaacctgtacaatgcagtgaaagtggcaggtgcccctgaggcaaaagggaaagggacgcttgttgttcttaacgaccggattgcctcagcccgatatgtcaccaaaacaaacacaaccacaacagatacatttaaatcagaagaaatgggcttcgtcggaacaattgcagatgatatctattttaataatgagattactcgtaagcatacgaaggacacggatttctcggtttctaatcttgatgagctgccgcaggttgacattatctatggataccaaaatgacggaagctacctgtttgacgctgctgtaaaagccggagcaaaggggattgtatttgccggttctgggaacgggtctttatctgacgcagccgaaaaaggggcggacagcgcagtcaaaaaaggcgtcacagtggtgcgctctacccgcacgggaaatggtgtcgtcacaccaaaccaagactatgcggaaaaggacctgctggcatcgaactctttaaacccccaaaaagcacggatgttgctgatgcttgcgcttaccaaaacaaatgatcctcaaaaaatccaagcttatttcaatgagtattgaagaaaagaaggcgaataagccttctttttttggctttttaggaccaataatgacctctgaatcttaaaatttctttaaaaataagccaaaattaccctttacttaattaatttggtaacgtaatataattgaagaatttgttacaaaaaaaggaggatattatgaaatttgtaaaaagaaggatcattgcacttgtaacaattttgatgctgtctgttacatcgctgtttgcgttgcagccgtcagtaaaagccgctgaacacaatccagtcgttatggttcacggcattggaggggcatcattcaattttgcgggaattaagagctatctcgtatctcagggctggtcgcgggacaagctgtatgcagttgatttttgggacaagacaggcacaaattataacaatggcccggtattatcacgatttgtgcaaaaggttttagatgaaacgggtgcgaaaaaagtggatattgtcgctcacagtatggggggcgcgaacacactttactacataaaaaatctggacggcggaaataaagttgaaaacgtcgtgacgcttggcggcgccaaccgtttgacgacaggcaaggcgcttccgggaacagatccaaatcaaaagattttatacacatccatttacagcagtgccgatatgattgtcatgaattatttatcaagattagacggtgctagaaacgttcaaatccatggcgttggacacatcggccttctgtacagcagccaagtcaacagcctgattaaagaagggctgaacggcgggggccagaatacaaactaatgagataaataaccttgaagagtcctattcttcaaggttattctgctttcagcacaatggttttcgccgccatatcatgaacggtttgttttttcttcgtaaatgcggctgtcaaatagatcaggcgggagaatacatgcacccacgctatgatgtaacggacaatcgcctgtaggaaagaaattttctcgtgtgtttcgtccctcacgatttgcagcccgatgatttttttgcccagtgtgcccttccaatttgtcagcggcatcagcaaaggatacacaatcagcatcaatatggcgacaataatgacaccagcggacccatcgccaaacgtaaatccggctgccaaaatcactgctgcggcaatgattacatcaagtaaaagagcgcaggcgcgcagcatgaaaccagctagttccaatagaaacactccttaaaatgttaaataaacacctaatgattgtaaaaaagaagggcctaaagtgggaataggtgataagccttaaatcacaaaagttggtgaaaatgtcataggtaaattggcataatcagccagcttatcacattaccaaattcttttttagcccgaaaccaagccctcagaagttatttttgttaaaatagaaaagttacaacagaattcggagggtttattgtgggaaaagtgaaacgaaatgccccttgcccatgcggcagcggcaagaaatataaaaaatgctgcggaagtaaagttgtcgacttcccggcggaactagcggcaaaagaagcgaaacaaattcaggaagacttagtggagtatgccttcacagtacatagagaaagcatttcaggctttatcaaccagcatgattttctttctgctatggacagacagacgaaagacatcagcgtatttaacttaggaatctggggaatcttcttccacccgcttgctggtgagaagacaatcttcgaagagtaccttcagaaaaaaggcgattcgatcactcgtccgaaaacgcgtgagatcgtagaatcatggcagagcatgacgcctgctttattgctgctgaaggacctgaaggaaggcatcattcactttgaagatgtcattacggcaaaacaattcgaagtggaaatggacgccagcaatcaagaccttcctccagtgggaagcctgattcttggatacccaatccacgaagcggaaaaagcagaattcttcatgcagttcacgatcttcccggtgaagagaacagaagcgctgatcagcaaggtgaagaaatatgcggatgccgctgtgaaggacggcaaaacgccggaggacttcatgaagcaggaattcaacaacgttctgttcgcgttgttagctgagaaagatgaagagccacaagcagagaaagcggaagtaagcactgttgagtgggcaaacgacttggagaaagaaaccgctgcggctattgaagaaggcatgagcggggaagagtatccgactgaattgatcccagctgttattgacatctggaaaacattctgcgagaaaaaatcacctgtcatcagaaagccggaagcttttgcggcggcagttgaatattatgtaaacgcaatttctcttaacggcgcgtccgtttcccaggctaaactggcgaaaaaatacggcgttagcgcatcaacgatttccagccgttacaaagaaattgaaagcacgctgcaagatgaagcagatcgttttgcacaagcgttatcctcataatggaaaaaaccttgaaaagccaggcttttcaaggtttttttatttctgaaacggaattttgatttctaaccggaagacggggtggcggtaggtaaaatccagcctgccaaaagcgctcttcaccagtttttgaatgatatatgtgcccatgccttcatgagcgccgtttttcgttgagcggccaaacgattgataaattgtatcgagcacttttgggtccatcccgggagtgctgttttcacaagtcagtacataaagtccgctgcgcagtgaagtttccagtttaatctctgctttttctcgggcctccgctgcgctgtcgagcgcattttctaatatgttgccgaccaagctgacctgatcagcaggcgaaaacggaagggaagaaagcggtgtatgcatatgcagcgaaacactcacattcgaggcgcgggctttttctaaaaaatcataaagcacccctgcaacgtacgcgttctctcctttcaaaaaacggtcatattggctgtattgatccgcccagttttgaatatatgcttgtgtatctgccttgggctgagctgatttgattgcagtgatatgtttcattgtgtcatgattctggcttctgacatcaatcagcatttgattggcgtgctgttcagcttgagtcagcttatcaatttgatcagaaagccttgcctgcaaagcagactgtccgatacggagcccttcacaccctgcaaatatcgcgattacacataataccggcatgatgtctgtgccaatcaacactactcccgccgacatcacttgaatcacagcaatccacgcacaaagccctgaggaacagtgtttccacacccgcttcgtattccaaatgtacaatcctgcagcagctgcgcctaaagcagcggcgagccaagaggcggctgtgctgtgtgaaaaagcagcagctccctgataacatatgaaactaaataaaaccagataaagacattgaaaaagggtaatcacgttctgaactcctcaaaagtagtagttttgaaaataatcaagctgctgcttggtgatcatcgcttttttagacgttccctcaaaagaaactgtaaatgaatgcttggtataagcggaaaaatgctttatgtaatgaatgttgataataaaggaacgatgcgaacgaagaaaatccttttcgggcaggtcgcctttaatatcatttaatgtttgatacgtttgcacctcttcggcggttgtcacaatcgtcgtcgaacgtcccgtccgttctgcgaaaataatatccttcttttgcaggacatgcatttcagacttttgctttatcaatatacgcccattcaaactcgtttccgttttctttttcaagtaccggtcgaaggaagcggccagacggtcggcatagtacggcttcataatataatcatggacgttcaggtcaaaggcgtgaaccgcataaccgccgtggccggtaacaaaaatcacatccacatcaagtgaatgggatttgatcaaatcagcaagctcgtagccagacatatggggcatctcgatatcggcaagcagcagatcaatgtctccgttctttacccgcctgtaggcttccttcgctgaatcggtggaaaagacaatttcgacgtcctgcattctggacacgatcgcttccagcttctctaaatctactcgataatcatctacaagtccgacttttaccattatcattcccctagttacatagaatcatctttattctatcccatttcgcgacataaaaagaactcttcgcgacaactttatccaactaatccagcttttcgtatatagtcattactagaaataaagataagggagattgtgacatgattacactgaccgattgcagccgcaggtttcaggataagaaaaaagtagtcaaagcggtgcgagatgtaagtttaacaattgaaaaaggagaagtcgtcggcattctcggagaaaacggtgccggcaaaacgacgatgctgagaatgattgcttccttgcttgaaccatcacagggtgtaatcacagtagacggctttgacacggtcaagcagccggctgaagtcaaaaaaagaatcggtgtcttattcggaggagaaaccgggctttacgacaggatgaccgctaaagaaaatctccaatacttcggcaggctgtatgggctgaaccgccacgagatcaaagcaagaatagaagatttatcgaaacggttcggcatgcgcgattatatgaaccggagagtgggcgggttttcgaaagggatgaggcagaaagtcgccattgccagagcgctgattcacgatccggacatcattttatttgatgagccgacaactgggcttgatattacgtcaagcaacatcttccgcgaatttatacagcagctgaaaagagaacaaaaaacgattcttttctccagccacattatggaggaagtgcaggcgctctgtgacagtgtcatcatgattcacagcggagaggtgatttaccgaggggcgcttgaatcactatacgagagcgagcgcagtgaggatttgaattacatctttatgtctaagcttgtcagggggatttcttaaatgctgagccatatttataaaaaagaaatgatcgacgctttgcgcgacagaaaaacgattttactcacaatcttagtgccgatgattatgatgcttggacttgtcttcttttatgaaagcatgctgtccgacaaaggggagcagtacacgctggctgtcggccattcgctgccgcccgcactggaaagcaagcttaatgagattgacgaaatcagcgtaaaaacatttgcaaagcctgaagaggcagttgatgaaggaaaagcagatgcctatctgaacgtcccaaaagagttcgactcatatgtcaacagcatgacaccttttaaggttgatgtttacggcaattcaatcgatcaagggtcgtcaaatgccatgcagcttgtgcagtctgccttagatcagtacaaaaatgaaattgtgcagcaacgtttaacaaataagcatattgatcaatcggtgatccagccgtttacaattcagcaaaaggaagcggatgaggagaaagggacttccgctattatgctttccgccattctgcccatgctgattctgacttccattgtttccggcgcaatgccgatcgctcttgatatcatggccggtgaaaaggaccgaaagtcaatcgaggcgctgctattaacgccagtcagcagaaacaaaatgctggtcggcaagtggcttgcggtttccacttttggcgtggcttcaggtgtattggctttgatgtttttgattttgtccaccgtgttatttaccgaaaatttaaaaacggccttccagctgggagatcatatgtggagtgtaatcggcgcttcagccttaatcattgtgctctctgcattgctgatatctgcgatggagcttttcatcagcatcatgtccagctcggtaaaagaagcgcaaagttatatgtctctcgtcgtctttctgcctgtgttcccgatgtttttcatcttcagcaaggcaccgaaccaatttgacttatcatactttctcatcccgtttctgaacctgcatgcgttatttaaacagcttttattcgggatggttgacccggctgccattttgtctacgtcaggaaccatcgccgtgctcatcgccatcttctttttactagccagagcctgcttcctgaaagacaaatgggttcttccaaaataaacttgcgaaaggagaaatacactttctcctttttgtatatcctgaaaaaagaaggaaaatagaaaaaggatatctaatacaaaaagtgaccctgcactatttttcatcaaaattggtttcaaaggagaaggaacaatggatcaaacacgtacactcggcaaaacgaagctgaaggtgaagcggatcggattcggcgcgaatgcggtcggcgggcataatctatttccaaatctaaatgatgaaacagggaaggatttagtgcgcacggcattggatggcggcgtcaattttatcgataccgcctttatatatggattggggagatctgaagaattaatcggcgaagtcgtacaggaacgcggcgtgcggaatgagctcatcatcgccaccaaaggagctcataaagaagtggacggcagcattgaattagacaatagccgggagtttcttcgcagcgaggtcgagaagagcctgaagcggctgaaaacagattacattgatttgtattatgttcactttccggatggaaaaacacctctcgctgaagtggcgggcactttgaaagagttgaaggatgaggggaaaatcaaagcaatcggcgcttcgaacctcgattatcagcaattgcaggattttaatgctgatggctatttggaggtcttccaggccgaatattctctcatacagcgtgatgccgagaaagagcttcttccatactgtgaaaaacaaggcatctcctttattccttactttccgcttgcgtccggactgctgacaggaaaattcacgcgagacacagtctttgatgatttcagaaaggataaacctcaatttcagggtgaaacgtttatccacaatctcaaaaaaatagataagctgaaagcagtagcggaggaaaaacaagcggatacggcacatgtcgccttggcgtggctgttaacgagaccggcgattgatgccattattccaggagctaaacgacctgagcaattacaggataacctgaaaaccttgaacattgaactcaccgaagacgaagtgaatttcatcagcgacatttttaaataaaaaggaaatagccgtcaaggctatttccttttggtgttttattctttgatgaatgcttcgactaattctgctgctctgtaatcatccatatcaagctgccattggtcgatgtcatttttcttcattttcacttcaactgttttttcagatgaagcaggtccaagctttttaaattcctcagggtagacttgaagcgcgtatttcactgcctcttcatagctggcactagagtttttactgtagtagtctttcactttgtcttcgatacggtctgaaagagaagatgcatctacaggtttaactgttgcttcaacaattgcttcgtctttagagattgaagtcgtttttgcttgaatggaagagtttttgcttaatccctctttaatgccgttcacgatattatcaagcgctttgctgtccgcatatgtgctggaaaggccggaagctgagagataaccgtctttggctgattcattgaaatcatttacaatttcatttttgttagcgccggtgattttttcgaaatcggcgttatctttgccgaaaagaaggacatcaacataagctgataacgcttttgcagaatcttggagcttatctgccgtcgccaggatttttttgtcttttccgtcaattttaaaagtaactgattttggctttttatcaccgtaagattccggcgtatagttaagctcgtattgcttgcctttatctacaacgaagaaaagatttccttcaacggatttgtcagcgttaatcgtgctgccttgaagcttttcgctatagtcttcagggtctgtgtcagacattttggtatcaccttgatacaatgtgaaatccatactgtctacattcagcgggtcttttcctgtgtttttcaccgcgacattgacttttaacacaagctggtcatctgaagtggacttatcatatttagacggaagtgtgtaagagacatccttgattttgacttgagctatatctgagcttttttctgtttctgattctttcttctccgcgcttgttttgctgccggaacaagcagctgtaaacatcatcagcagaagaattaggaaaacagcgtacgtttttttctgaaacattcatttttcctcctcaaatggtttaggaaaggggagtcttttgtctttgagaaatggatctttttgaatggattagcatcatataaccaaaaaaatcagttcttttctcacggtttttaccggattttctggaaactccgccctcctttgtcatgaatggacctataaaaagttacaacggaattaattttaagattattagcttttatattgaataggttcatcatcctatttttggtgaaaaatgttctggtaaaactggtaaactcagaaaactgtgtattttagactattactttttgattagttggagggaacttaagaaggatgaaaggggctgcctttgtgaagaaagagggactgaaacaaaaagcactggaaatcggccgggtgccgacacacttaaaactggaaattgaagattatggcggtgatgacaaaagagcctatttttgttggagagatcctcaggatgagaatatcggcattatcgtggaacttggaccggacggggagctggaatccctttcccgtgatattgagcctgaaagcggagaaaggctgtctgaggagaaactagaggatatcatgcgccaatttgtcgagactcatcatccgggggcactctctgcctttgttcgtgaagaaaatgaccgtgcatacggcgataaagtgagattttcatatgttcaaatggaggctgggcttcctctccccatgagcggatttatggctgatgtttccttatcaggtgagatcgtttacttccgctattacggcgaagcaggcagcatcatcaagccaaagagggtcgcggatgttgaagaggcacttgcctttatcaagaaggacgtagagttcgaccttttgtttgaggttctccatcgttctgtttacaaaaatggagatgatcagccacatttggtgtatgagcctgaatgtagggcgattaccgtacctgcggatttggttcaagaagaacaaggaggagttgatgatgacgataattacagggagcctgagagctttcctctccctttattcgagggcatccgcgaaaaggccgatcctgacagcatgattggtattgaaaatgggtttgtcaaagagcgggaagcggatttgggagatgggagaatcggaatcgtttggcggaatccggatgaccctgtgtatcagccggcggataaaagcatggacagctggtttaagggacggactcatcaagtgctgaaaaccatctataacaaagaaaccggaaaactcgaaggcgtcatgtcatttatggaggaaaaagggccgctgacagtaactttggcagagtgcgaaaaaattgcgcttcgctttctgtttgctttatttccgaatgccgatcaatattttaggatcagatacgatgaaaaggatgaagaagaaaacgcagtcactgtttttacatttgaaacgcattgtcacggagttccgctccgatttgggcagatcaaaatttgtgtcagccgccagacagggtatatcaccgtttatatgggaccggatattgacccaaatgagctggcaaccattgatcctgtgccggccatttcagttgaacaagccaaggctatcttttggcagcattttaaagttgagcttggctgggaaagagagtacggagatgatgaagaacacagctaccggctcgtctataagccggtgtatccgcgttttatcgatgcacatacaggagagcctgtcttcagctcatggtaaaacagccaaaagtcacgcaattgcctcaggtatagaagagagtacgtgatgaaagtaacagaaagaatctcgaaaaacaatgacaataatagaaaaggacctttcttcactttaaaagaagaaaggtctttttatataataaacaggattctctttgtcgtagactctttgaaagggatgacttcattggttaataaacagctgaaaaagatggcgcaggagatcggaaatgtaccgacgcattatgagcttgagatagaagattacgaccaaaagcaaaagaagaacgggcaggcatattttatctggaaggaccctaaagatccggaaaggcacattacagttgaacttagaaatgacggcgctttgctcaccttttcaacaactgtccgctccgagacagacaaaaaacttccagatgctgagctgaagctgacggctcttcagtttgccgctgcccatcatcccggcacatttatgaattttcattttcaaggcaaggaagaacgggggcagcacatccggtttgtctataccaaaatggagctggggcttccgattcccaattcaggctttttaattgatatgacacgcagcggtcagattgtccactttctatattacggggaagggcataaagccgaagttccgacggaatttgtagcaaaagagaaggttgtgtcccattacttaaacacaatgtcttttgagctgatgtacgatgtcattgatggcgaacaggaaccaaggcttgtatatgaaccgattctcccgggatacagctatcccgcagatgtagacgaaattgtgcccgatcagcatatcgcagatgaaagaatagaaaacacggcgtcactgccgccgcttcagaacaaggaagaagttgatatatttgccttgctgggttttacctctgatatgcagaaagtcagtgaaagagactttggggaacaaattggaagcacgtggcgcaggggcgctgcgccggagcgtaaggatttaagcataggaagctattttgaaacgagaaataaaaacacaatcaaaatgaagacggataaaagaaccggaaaattaaaagcagcgctttcttttatggagcggccgaacaaccgccaatgctccacggaagaatgccaagagatagcgcttcaatttttgtatgccctctatccgagagcggctgagtttttcagggtgaatcccgtccgaattgatgaaagagggagagtccgcaaccatttttctgtctggtataaaggagtgccgctgcggttcggcgctgcccgcatcattgtcaatccggaaactgggttgattgacgcttttatggcgcctgatattgaacctgaacaattggaagcgataaatcacaggccggatgtttccgctgaagaagcaagagaagcgtttttagccgcttttgatgtgaagctggaatggcagcctgattttacagcaggcagtgaccagcactacaaacttgtctataagccggtttacccttcatatattgatgcgcacataaggaaaaagaaaaggctgtgaggggtgtctagttaggaatcatctccaagtgggggtagtccttgaatcgtttccaatccccgccccattcaaaaccgagtgtcttagcgatctcgacaacctccagccaatctgattttccgttttgattgccgtcatattccatatcccatatgatgcttccatcctttttttgaagggcgaaatcaatcgctaaaccatagttatgatacgattcccctcctcttgcataggtgacaatattccctttttttgtacgtccctgtttatataattcatcttgttccttaaaggacctgaatccttcagtaatgacgacggtaatgcctttattcgctgcagcggctttgagtgcatcggcattctgcttcacaatcggatgaagatccgaggggacaggcatgtcctgcagggcgttttgagaatgccattcatgccgaatataactaaaacaaagatctagaagaaatagaatacataagataacaaatgtttttgcgggtaacttcatatcggtctcactttctcaagatgtgctgaatgtgaacgcttttaagtgattgactctctctaaaagcgaacagctatgataaaatataacataaatagtagcaggaggaaggaggcagaccgatgagagcaaagattccatcagaagaagtagcagtaaagctgaatgaatggtacaagctcattcgcgcatttgaagcagatcaagcagaagcgttaaagcaggagattgaatacgatttagaagatatggaagagaaccaggacttgcttttatatttttctttgatggaattccggcatcgaatcatgcttgataagctgatgccggtgaaagacagcgacaccaagcctccgttctctgatatgctgaacgaaattgaaagcaatcagcaaaaactcacgggcttattggaatactacttttattatttcagaggaatgtacgaattcaagcagaaaaatttcatattagcgatcgaccattataaacatgccgaggaaaagctcgagtatgtcgaggatgagatcgaaaaagctgagtttctttttaaagtcgcagaagtgtattatcacatcaaacaaacgtatttttccatgaattatgcgagccaggcgcttgatatctatacgaaatatgaactgtacggtcgccgccgggttcagtgtgaatttatcatcgccggaaatttgaccgatgtgtatcatcatgaaaaagcactgacccacttgtgcagcgctttagatcatgccaggcagcttgaagaagcatacatgatcgccgctgcctattataatgtcggacactgtaagtacagtctgggtgattacaaagaagcggagggctatttcaaaacagccgccgccatttttgaggagcacaactttcagcaagctgttcaagctgtattttcactgacccatatctactgtaaagagggaaaatacgacaaggcagtagaggcttatgaccgcgggataaagagcgcggctgaatgggaggatgacatgtacttgacgaaattccgcctcattcatgagctgtatcttggaagcggcgacctgaacgtgcttacagaatgctttgacctgctggaatccaggcagcttcttgctgacgccgaagatctgctgcatgatacagcggaacgtttcaatcagttggaacattacgagtccgccgctttcttttaccgcaggctgatgaatattaaaaagaagcttgccgagcagcgttttcaataggaaatggcagagaactacaggttctctgctttttttgtgctgttttcaactcggaaaaacagggtattttccactgcatagtgagaaacagaggaggatatcaagtatgtacaaagatttaaccggaaaaacagcgattgtgacagggtcttcaaaaggaatcgggaaagccattgcggaacggttcggacaggagagaatgaatgttgttgtaaactaccacagcgacccgtctggagccgatgaaaccctggaaatcattaaacagaacggagggaaagccgtcgcagttgaggcggacgtgtcaaaagaagaggggattcaggcgctcttggacacagctttagagcatttcggcacgctcgatgtgatggtaaacaactctggttttaacggcgttgaggcgatgccgcatgagatgagtcttgaagattggcagagagtgattgatgtcaatgttaccggaacctttctgggagcgaaagcagcacttaaccacatgatgaaaaacaatatcaagggcaatgtgctgaatatctcaagtgttcaccagcagattccgcgccctgtaaacgttcagtattccacatccaaaggcggcatcaagatgatgacggaaacgctggcgctcaattatgcggataagggaatccgcgtcaatgcgatagcgcccggcaccattgccacagaatcaaatgttgatacgaaaaaggaagagagcaggcaaaaacaattgaaaaaaatcccgatgaaagccttcggaaagcctgaagaagtggcggcagcagcagcttggctcgtatctgaggaagcaagctatgtgaccggcgcaacacttttcgtcgacggcggaatgacactttatccatctcagcttgaatagaacacaaaacagggggattgcgggatgaaaacggactggtggaaggatgcagtggtgtaccaaatttacccgagaagctttcaggacagcaatggagacggaattggggacttgcgggggattatttcccgtcttgactacataaaggagctcggggcagatgtgatttggatttgcccgatctatccttctccgaatgttgattacggctatgatgtgacaaaccataaggcgattatggattcttacggaacaatggacgattttcacgagctgctggaccaggtgcatcagcggggattaaagctggtgatggactttgtgttaaatcacacctcggtcgagcatccgtggtttaaagaagcggagctggacaaaaacagcaaataccgcagctattattattggcgtcccggcacaaagaacggcccgccgacggactggctctcaaactatggatgcccggtctggcaatacgaagagcacaccggagaatactatctccatatgaatgccgtcaaacaagctgatttaaactgggaaaatcccgaagttcgccaggcggtgtatgacatgatgaaattttggctcgataaaggggtcgacggtttgcgaattgatcagctccatctcatttctaagaaagaatatcttccttcgtatgaggactatatcaatcagcaggcagagccgaagccctttcagccaaatggcgaacaaatccatgactatttaaaagaaatgacagatgaagtgttttcccaatatgatgtcatgtctgtcggagaggttggcagtgtcacaccggaagaaggcctgaaatatacgggaacagataagcatgagctgaatatgatttttcactttcagcatatggagcttgatcagcagcccggaaaagaacattgggatttgaagccccttgagctttctgatttaaaatcggttttgacaaaatggcaaaagaagcttgaacatcaaggctggaatacattgttttggtgcaaccatgaccagccccggattgtgtccagattcggagacgatggggaataccgcaaaacatcagcgaaaatgctggcagccgtactttattttatgaagggcacgccgtatatttatcagggagaagaaatcgggatgacaaacgcgccgtttacccggattgaagactacaaagatatccaaacgatcaatatgtatcataaacgggtgtttgaaaaaggctatgatccaaatgatgtgatgagatcgatcttagccaaaagccgggatcacgcccggaccccgatgcagtggaacagcggcaaaaatgccggatttactgacggcacgccttggctgaaggtcaatccaaacttcaccgcaatcaatgtggaggaagcgcagggagatcctgattcggtcttaatctattacaaaaagctgatcagcctgagaaagcagtacgcggacctcatgaaagggagctttgatcttttgcttccggatgatccgcagttgtttgtatacatgagagaaaacagtaaacagcagcttttgtcggtcaataatttttcaaaagagcaggctgtttttcagtggcccaagaactgcggcaaagctcaggcctctctgcttctcagcaattataacaacgatgatcttgctgacgaaatggtgttccggccttatgagagcagggtctatcttctggacaaaacaaactaatgattgaagtagcccggcatttttagccgggttttttagtacatatattcgctctgcaggcgggaagaataaatgaaaatgaaatttattcttgcaaaacgtaatgacttcggtttattatgatataggattacaaaatcgttatcattttgatttaaagtttctgaaaaagaggggatatacgatatgtttaaaaaatggagcggtttgtttgtgattgcagcgtgctttttattggttgcagcatgcggcaactcatcaacaaaagggtcggcggattcaaagggtgataaactgcacgttgtcacaacgttctacccgatgtatgaattcacaaaacaaattgtaaaagacaaaggcgatgtggatctgttaatcccatcttccgttgaaccgcatgattgggaaccgacgccgaaagacattgccaacattcaggatgctgatttgttcgtttataatagtgaatacatggagacatgggttccgtcagctgaaaaaagcatgggccaaggccatgccgttttcgttaatgcaagcaaaggcattgatttaatggaaggctctgaagaagaacacgaagagcatgatcatggggagcatgagcacagtcatgcaatggaccctcacgtatggctcagccctgttctggcacagaaggaagttaaaaatattacggcgcaaatcgtgaagcaggacccggataacaaagaatactatgagaaaaatagtaaagaatatattgcaaaactgcaggatcttgataaactatatcgtacaaccgcaaaaaaagcggagaaaaaagaatttatcacgcagcatacagcttttggctatctggcaaaagaatacggcttgaagcaggttccgattgcagggctttcacctgaccaagaaccgagcgcagccagcttggcaaagctgaaaacatatgccaaagaacataatgtaaaagtcatttactttgaagaaattgcatcctcaaaggtcgcagatacgctcgccagtgaaatcggcgcgaagacagaagtgctgaatacactggaaggcttgagcaaagaagaacaggataaaggtttagggtatatcgacattatgaaacaaaacctcgatgccctgaaagattcactattggttaaatcataagatagtgtgcgccggagggtgcacactatttctttgtgagaaaggaagattaacatgaatctcgtctcattgaaagatatcgttttcggctattcccatacgcctgttttagataaagtatcacttgatattgaaagcggtgagttcgtcggcatcactgggccaaacggcgcctctaaatcgacgctcataaaggtaatgctcggcatgctgaaaccgtgggaaggcacagtgacgatcagtaaaaggaatacagaagggaaacgcctgaccatagggtacgtcccgcagcaaatttcttcatttaatgccggctttccgagcacggtgctggagcttgttcagtcaggccgctatacaaaagggaaatggtttaaacgtttaaatgaagaagatcatcttgaagtagaaaaagcactgaaaatggtggaaatgtgggagctccgtcaccgtaaaatcggtgatttatcaggcggacagaaacagaaaatctgtatcgccagaatgctcgccagcaacccggatctgctgatgctggacgaaccgacgacagctgttgattacgacagcagaaaaggattttacgaatttatgcatcaccttgtgaaaaatcacaaccgcacagttgtgatggttactcacgaacaaaacgaagtacagcaatttttagataaagtgattcgattagagagaggagaaaaaggcggatggaaatgtttgacttggaattcatgcgacgagcttttctagcaggcggcatgatcgccgtcatggctccgatactaggagtgtatctcgttctcagaagacaggccttaatggctgacacactttcacatatctcattgtcaggtgttgccatcggcttttttctcagcaccaatataaccgcagcaagcatagtcgtcgtgaccatcggggcgatcggaattgaatacatgcggcgggcgtatcggacttattcagaagtgtccattgccatcttaatggcagctggtttgtccttcgcgatgtttttaatcagcctttccaaaggcacagccaatatgagcatcgatcaatacctatttggatcgcttgtgacagtaaaccagcagcaggtctatattatcagtattatcacactgctgatcctgctttattttatcgtactgagaaggccgctctacctgctgacgtttgatgaagcaacagccaaaacatcgggaatcaatacaaacgttctctcgttgtcattcagtattgtcacaggccttgcgatttcagtcattattccgatcatcggggtccttcttgtatcggccctgctcgtattgccggcagcattcgccatcagaattgcaaaaggctttaacatggttttcattacagccatactcatttcattattcagcgtatttacgggactgacatcatcctatcagctcgggacgccgccaggtccgtctattaccctgctattgatcgttttgctattaatcggatttgcagttcagggagtttggacgtttatcaaaaaagaagctcagcgcaaaaaaaggcaccgataacatgaaaagcagttttccctagggaaaactgctttttttatagaaacaatccggcaaggcgctcataagattcttttttcgcctcaaaatcaaacacattgcacagaaccatgatttcatttgtttcgtagcggcctgtgaggtctaacagctgttgtttgacagtggttggagaaccgatcaccatccgctttctgttttcttctatgagttttttatcggacgctgtgtagggataggctttcgcctcctcgatgcttggcacgcggctgtccaagccttttccgacgcgaagaagccacaaatcctggcttaatgcgagttcttctgcctcttcatctgttttcgcgcaaatgacaaaaatcgtaaacagtgcggacggattcgaaaaatgggctgagggccgaaagctttcccggtagatgcggaatgcattttctcctcgctcgggattaatgaaatgcccaaatacatatccaatcccctgttgcgccgcgcgtcttgcgctgttttcaccaagaccgagcacccatagctcgggtgccgtgtcaataaggggcgccgctttgattccggcatacggatggtcgggaggaagggaatctgttagaaaataagagacatcctgcagctgtctgttaaattcggttaagctttttttcaccccgtccgttaatgcaagcctggtttttgtcgtgccgccgggggaacggccgacgccgaggtcaatccggtttggatacagggcctcaagctggcgaaaggtttcagccactttaaatgggctgtattggggcagaagcacgccgcctgatccgacacgaatggtgtttgtctgtgctgcgatgcgggcgatcatgatttcaggcgctgtgcttgccagtcctttcgtgctgtgatgctcggcaaaccaataacgcttatagccccactcttcactaaatcgagcaagctcaaccgaatgctgaagagttgtcacagggccctctcctttagaaacaggagcctgatcaagtatgcttaaatgaatcaaaaggccgcttcctttctgtctgtttttagatggtgacaccagaataggcaaaatgacttgcccgcgtcaaatggtttgtttaagaagcgcactttatagcatttgcaaatcatatatcaaatatggaagttttttttcgaggtttttcgtcaattattcttaacttttacgaaactttgatataataacaaacgtatatattagtaatttacggcttattttccttgtgagcgtaaaaataaatgtgactatcttcacattttgatgagtaggagtgaatcgtgtggcaatttctttagaaaaaggtcaacgaattgatttaacaaaaggaaaagccggtctgtcaaaattgatggtcggtctcggctgggacccagtgtcctcaggcggagggttcttcagcaaactgcttggcggaggcggtccgaatatcgactgtgacgcttcagtgctgatgttggaaaacggaaaattcaccgataagaaaaacctgatttatttcggcaacctgaaaagccgctgcggcggtgtacagcatacaggcgacaacctgacgggtgacggtgcgggcgatgacgagcaaattatgatagatttagataaagtgcctgcaaacatcgataagcttgtatttgtagtaaacatttacgattgtgtcagaagaaaacaagatttcggcatgattcaaaatgcgtttatccgcgtagttgatcaatctaatcacgaggaaatgctcaagtacaatttgagagacaattacgccggcagaacaagcctgattacagcagaaatctaccgcagcggcagtgagtggaagtttgcggcgatcggtgaaggcacgaacgatacgagattagaagatattatcagccgatacgtataaaagaaaaggagtggatgaaacatgacaatttcattggcaaaaggacaaaaagtagatttaacaaaaacaaatccgggtctttcaaaggttgttgtcggtttaggctgggatacgaacaagtatgacggcgggcacgactttgatcttgactcaagtgtgtttctgttagacgccgcaggcaaatgcgcgtcaccaaacgactttattttctacaaccagcttgaaggcggcaacggttcagtcgttcattcaggcgacaacctgactggtgctggcgaaggcgacgatgagaatgtaaaagtaaatctcagcgctgtaccggcaaacattgataaaatctcatttgttattaccattcacgatgcagaagcgcgcagccaaaactttggacaagtatcaaacgcgtttgtccgcatcgtaaatgaagaaacaaatgaagagctcatccgttacgatcttgcagaagatttctctattgaaacggcaatcattgcaggggagctttacagacataacggcgagtggaaattctcagcaatcggctcaggctaccaaggcggccttgcccgcattgcaacagactacggtttgcaagtcggttaagacaaatacgaagagcagaaaggagagaggcagtatggccattcaattatcaaaaggacagcgcattgatttaacaaaaacaaatccgggactgactaaagcggtgatcggcttaggctgggatacaaacaagtattccggcggacacgattttgacctggatgcttcggcctttttagttgatgcgcatgataactgcgtaaatgatctcgatttcgtcttctataataaccttgaacatccgagcggcggtgtcatccatacgggtgacaaccgcacgggtgagggcgacggagatgatgagcagattatcgttgatttctcgaaaatccctgctcacattgagaaaatcggcatcacagtgaccattcacgacgctgaagcacgcagccaaaactttggacaagtttccaatgcatttgtccgcgttgtggatgaagaaacgcagaatgagcttcttcgcttcgatttgggagaagacttctccattgaaacagctgttgtcgtttgtgagctttacagacacggcggcgagtggaaattcaatgcgatcggcagcggattttccggcgggctggctgcattgtgccggaattacggtttgcaagtgtaagcgagtgacaaatagagaagtcaccgtttcaaattaataggaggaaaaaacttggactttttacatcatattttgtctacgtatgcttcatttttcgattggaaaatgtggggggaagttctgactgatcctgtttcctggggtttgatcggttcccttgttgttctggaaggccttttatcggccgataacgcgcttgttcttgcggtcatggttaaacacctgccggaaaaacagcggaaaaaagcgttaacgtatggtttgtttggagcttatattttcaggtttattttcatcgggctcggtatgcttctcattaaattctggtggatcaaggtgcttggcgcgctttacctggcttggctcgtcattaagcacttctggattggcgaaaaagaagaggaagcggacggcatcaagaaaaactcttggatggtccgcacgttcgggatcttctgggcgactgtcatttcagtagaattaatggatcttgccttctctgtggacagcatcctagccgcgtttgcagtatctgaaaaagtatgggtgcttctgatcggcggtatgcttggtattttaatgatgcgtacagtggcaaaagtgttccttgtgctgattgataaaattcctgagctggaaaacacagcattcgtgttaatcggcattatcgcgctgaaaatggcggggagcgctttccattacgaaatgccgcactctgtattcttcattatcattatcgctgcatttgcggtaacattgatcattcactacatcaataaacaaaagcaggtgcgcgaacaaacagccgcttcaaaagaagaataaaacaaaacaaggagggaggttcaatgtccttccttttttgttaccgaaatatcgttcaatgacaaaccggaaaggaggatatgatgagacaagaagaactaaccattcataaagcacttccggctgatggcgattggaaaagcctgctgtttcagccattgccggagcgggatcactatgaaactgcacaaggcctttctttttctcgtcttgccggtcagatattgggcacgcctattgatgagacggactactataacgagctatatgagctgtctgtaaacgaccgcataacgattttgagtgaaacgcttgataaaacaatcgaaccggaaacatttcaaaagcttcagcatattcattccatcaatcagaaagaaaaagggctgtcagtcagccgctttgttgcctttctggacggggaaaagctgattgcgaagcactcaaatcccctgatgcaccgccatttaagaaaagcgctgatgacgcttttacatacctttgcggacagtcatgaaaaggggctgaatcatcctgattttcgcagagtgctgcttgatgtctcgaagttttccttaaaccatctgaacccttggctggaaaaaaccgatatagagcgggagatgccgaaggttgtttggtatggagatgcgacgaaaagccagctctatttcttatattatctgatgctggtcggctgtgatgtactgctgttccatccggcgggaacggatcagctggcgcttgtcgacccgaagcaggagctcggttttacggaaaagctcccggatgtttcggagcttcagccgttcccgaaagaaaaaccagaccggaaatcaacagtggcttaccgctcaacaaaggaaattgaacatgtgctgaatcacgaggaatccatgctgtataagccgtggcagttcagagatcacacaccggtgtccgttacgctgaaaacgacctatgatgaattgtttttaatcacgaaagaacgcgcctttattcggccgaatttcaaagctgataaacattcaattgagattccgaatgtattcgccaaaattatgggcgtgtcgaaagacaataaggaatattggaacaggcttcatactctagcggattatcaggaaacagaaatggtcagaagctttccatttacagaagaaataaagtcgaactatcaatttcactacagccacgcacttgatcaagaagggaacattgatccggacaagctgatggcaagcaatgtgtggcagtacaaacagctgccggcgggcgttcagactgccattgccaaaacgatttcgagaatgtgcaggcacccgcggcttaaagctttgcatcaggaacaagtcaaggatgttcaaatctatttgtttaaacaaacaacaaatctgcctgctaatctgctgaaattgattcaaatgttcgactatgcgcaaaccgttccgaaactcgttttatatcatacggaaatgagcggcggactcacgcgttcggatgctgctgccctgctgttcctgaatgaaattggaatcgatatcatcatttataatccgcccggacaccaagatattgagcagtttattgaagatgaccagtatgatatccactggctggatgacatggtgtttcagcaggactacaaagagccttcgcttgtgaaaaggctcttcagaaccattacccaaaaataaggagagaagaaaagcatgacaacagaaaatcaaaatccgcttgttctcgataaaaatgaagagatttcccagcaaaaagctgacgatatccgtcttcagcttcgtcaggaaccagaagtgaagcggcttgctcaacaaattgacgtcaaaaaccaaatggagctgcttgagtacggcaaggagccggccgttgaaatatccaagttctctgaccgcatcttagggatgatgaaaacaacaagcgtgacagactccggcacaatgctgactcagcttgggaaaatcatggaccgcttcgacaaaaatgattttgatgagccaaagggattaatggcgaaaattttcaaacgcggcggcagcatgattgaaaaaatctttaaaaagtatcagacgcttggcggagagattgaaaaaatccacgttgagatttcaaaatacaaagatgagatgacgaagacgaactacacgctcgatgaaatgtatgaaaacaatatcaaatactatatggagcttgaaaaatacgtcgttgccgggcagatgaaactggaagagatgcagtcgatccttccttcatatgaggaaaaagcggcaagcgggaaccagctggcgcaaatgcagctcgatacgttgcgcaacggcattcaggcgcttgaggaacgggtgtatgatctggatatggcacggatggtggcgcttcaaactgctcctcaaatccgtctcctgcagcgaggaaatgcaaagctgatcgggaaaatcaactccgcgtttatcattaccattccgattttcaaaaacggcattattcaggctgttacggtaaagcggcaaaagcttgtggctgattccatgagcgagcttgaccgccggacaaacgagatgctgaaacgaaatgctgaaaacatctcgagccaaagtgttgaaattgccagaatggccggcagaccgagcatagatattgaaacgatcgaatcgtcttggaacacgattgtcagcggcatgcaggaaacaaaacaaatcgaagaagaaaacaagcgcctccgcgaagacggcgcgagacgaattgcacagcttcaggataatattaaaaaagcagcattgcagcaataagaaaaaccccgcttgtggaacataagcggggtttttcaattacatcatttagttaatgacaatgtgtaaagacaggtgtaaacttaaacggtaatcattttgcatatcagaggtgttggcaatgggaaaacaacagcctatatcccagcgtaaactgctgggcgtcgccggtttggggtggctgtttgatgcaatggatgtcggaatattatcgtttattatcgccgcgctccatgtagagtggaatctgtcgcccgaggaaatgaaatggatcggaagcgtcaattccatcggcatggctgcgggtgcgtttttgtttggtttgcttgctgatcgaatcggccgcaaaaaagtgtttatcatcacccttttatgcttttccatcggaagcggcatttccgcttttgtgacgagcttatcggcatttctaatccttcgtttcgtgattggtatgggacttggcggcgagcttccagttgcttcaacactcgtttcggaagcggttgtgcctgaaaagcgaggcagagtgattgtgcttttggaaagcttttgggccgtgggctggctcgcagcggccttgatttcttactttgtgataccaagctttggctggcaggctgccctgctgttaactgcgctgactgctttttatgcgctgtacctgcggacgagtctgcctgattcgccgaaatatgaatcgctttctgccaaaaagaggtcggtgtgggagaatgtaaaaagcgtctgggcaagacagtatatacggccgaccgtgatgctgtcgatcgtttggttctgtgtggtgttttcttattacggcatgttcctatggctcccgagtgtcatgctgctgaaaggcttcagcatgattcaaagctttgaatatgtcctgctgatgacgcttgctcagctacctggctatttctctgccgcatggctgattgaaaaagcgggccggaagtggatactcgtcgtttacttgattggcacagcaggaagcgcctatttcttcggaacggcggattccttaagtcttctgcttacggctggaatgctgttatcgtttttcaatctcggtgcatggggcgtgctgtatgcttataccccggagcaatacccgactgcgattcgagcaacaggttcaggaacgacagcagcgtttggaagaatcggcggcatcttcgggcctttgcttgtcggaacgctcgcagcccgtcatatttcgttttcggtcatcttttcaatcttttgcattgcaatcttactcgcggttgcttgtattttgattatggggaaagaaacgaaacaaactgagctagaataggaaaagcacctcttgaatgaggtgctttcgcgtgtcgacaaaccctcgcattcgttgtcaggactgcgcttcggtgctcaatgcgaagtggatcaacggctaaattctcaggcgtcctgcctaaacgccgtcgtcatcacatcctgtgaatgtccgctcctatgctcgtccttcctagacttcaagggttttcaatcacgctgaaaaaatgacaaaattctaaaatgaaaaccattttagaattttgtcaacaatctgaggtacctctgaatgaggtgcttttttacaattgcgcccgggctgcggattggcgtttcccggttttactaattgtctggtagagcgtcatagaaagtatgaacagaatggcagtaaatcctgtgacagctccgaaatgctgtgtgctttgatataaaaaacctgcaatacttgtaccgacagtggttccggcatacatagcggcattggaaagggaagcaatggttcctcgcgcatttggtgcaatggattgaaagacacccatcattaacggaaagatgatgccagctgtaaagaacgtgagaaaaaagccggcttctactaaaaacaagtttggaaagaacggaagagcgaaatagagagcgcccattagcagcatcccgctgatcagtgttttaaacatgcccagcttttctgaaacccggctgccgataaggctcccgagcatatttcccagtccgagtacaagcatagctgcgccaatttgtgacacggttaaatgataatccgcggaaagccaagtacccagaaagctgaacgatgcgaagtttccggtttgaaacagaaaataggcaagcagaatgaccgatgttttcggcaatgaaaaaagctcccgataggggttgacaattgatgggcgcgccaatggttcagaaggccggatgccaggcatgaccgccgccaggatcaatagaagaataagcgagcacgctgacaaaacgaaaaatggcgtatgccatgtaaaggaagcgagaaaccctccaataggaagtccgagcatttgtgaagcggccaaacctgctgtcgcaatccccatgccttttatgatctgagaaggctggacaatgactgggatggacgcccaaatttgaggcgtcacaaacgcagcgctaacgcctgcggcaaaacggaacaggcacatggcggcaaaagagggagcgatgccgcataaaaacgtggatacaataaagcctgcaagtccccacagcatgactgttttcctgttcagccggtctgagattgggcctgcaatgaaagcgaagagcgcataaccgagtgcataagcactgaccatccagcctgacaaatcagtagagacatgaaactgatcctgtaaaagggggagaagcggcgaaagcaaaaaggtatccgtgccaatgacaaacatgacactgaagaaaagccaaatgcgattcaaatttatcactcctattgttttataactttgaaactatgaaacagatatgtatagagaaaaccctttgttagagggtttccaaaaagccaggcaggtatgtttgaaatgtgtcttcacgcagactgacgtattttgtccgcgaatctttccgggttgccgtcaatcccgcttcacgcagcgttttaaaatgataagatgccgtggttttgacaatattgcacttttcacctacttcaccgcagctgagttcttttccgctgacataaagcgtacgaataatggcaagccttgattcatcagacagtgctttaaaaatttgcgctctgatttgatcatctgattgtttcatagtcatgaaactataatacataatgggtgttgaaaaagcaacttatttttccagtaaaggagcaggaagtcataagaggaaggaggaattcaattccaataaaagcgttttcaactaaagataggcgaaaaatcacccgtaaaatacaatcatataggaggattacagagcatttagaagcataaataagatcatgtggtcacatggatgtttataaagaaatggtacagaataaaagagaatatgctgtttgtgtaggaagttacataaatgttacggtaataaagattgcttaatatggagggaaaatatgagtgtagatgagaaaccaattaagataaaagtcgagaaagtctctaagatttttgggaaacaaacaaagaaggcagttcaaatgcttgccaacggaaagacaaaaaaagagatcctgaaagcaaccggatcaaccgttggggttaatcaggcagattttgaagtatatgatggtgagatatttgtcatcatgggtctatcagggagcggtaaatcaactttagtacggatgttaaaccggcttattgaaccgactgccggaagtatttacattgatggtgacatgataacaaatatgtcaaaagaccagctccgggaagtccgccggaagaaaatcagcatggtcttccaaaagttcgctctgttcccgcacagaacgatacttgaaaacacagaatacggactggagcttcaaggtgtagacaaacaagagcggcagcaaaaagcgcttgagtctcttaagctcgttggactggaaggatttgaacaccaatatcccgaccagctttccggcgggatgcagcagcgtgtcggccttgcccgcgcgttgacaaatgatccggacatccttctgatggacgaagcgttcagtgcgcttgatccactgattcgtaaagatatgcaggatgagcttcttgatcttcacgataatgtcggaaaaacaattatctttattacgcatgacttggacgaagcgttgcggatcggcgacagaattgtcctaatgaaggacggcaacatcgttcaaatcggcacgcctgaagaaatcctgatgaatccatctaacgaatatgttgagaaattcgtcgaagatgttgatttgtctaaagtcctcacagcaggccacattatgaaacgcgctgaaacagtgcggattgataaagggcctcgcgtagcattgacactgatgaaaaaccttggaatttcttcaatttatgcagtggataaacaaaagaaattattaggtgttatctatgcgtctgatgctaaaaaagcggctgagtctgatttgtcacttcaagacatcttgaatacagaatttacaactgtaccagagaatacgtatctgactgagatttttgacgttgtgtccgatgcgaatattccaattgcggttgtggatgagaagcaaagaatgaaaggaattgtcgtaagaggcgcgctgattggcgcacttgccggcaataacgagtatatcaatgctgaaggcactaacgaacaaacacaagatccttctgcacaggaggtgaaataagatggatagactgcctagaatacctttagcagatattattgaccgttttgttgactggattacgatgacgtttggcggattcttcgacggaatcgctaacggattggccgcttttgtaaatggaattgtcaccggtcttggatttattccatctattttgttaacgattattttcgccgcacttgcgtggtggatcagtacaaggggaattgcgttatttacgttgattggattcctcctgatcgattatttaggatattgggacccaatgctgcaaacattggcgcttgttttgacatctgtgattatttcgattgtggtcggggttccgatcggaatttgggcgtctcagaaagaaacggttcgccgtattgtaacgccaattcttgatttaatgcagacaatgcctgctttcgtatatctattgccggcgattttcttctttaacatcggtgttgtgccgggtgttgttgcatctgttatcttcgcgatgccgccgacaatccgcatgactgttctcggtattaaacaagtgccggcggatttgattgaagcgactgaggcattcggttctacaacagttcagcgtttgtttaaagttcagcttccgcttgcgacaaaaacgattttggccgggatcaaccagagcatcatgcttgcattatcaatggttgttatcgccgcaatggtcggtgcaccgggacttggttctgaagtatacagtgccgttacacagctgaaaaccggggtcggagtagaggccggtatcgccatcgttatcgttgccattaccctggaccgtattactcaaaatattaaagtgaagaagaaaagcagggggaatgcctgatgcttaaaaaaatcatcggcatcggcgtttccgccatgctggcgctctcacttgcggcttgcgattcagaaaacgatgaaaatgcatccgcagcagaacaggtgaataagaccatcatcgggattgaccccggttcagggattatgtccctgactgacaaagcgatgaaggattatgacctgaatgactggacattgatttcagcgtcaagtgctgcgatgaccgctacgcttaaaaagtcatacgaccgtaagaaaccgattatcattacaggatggactccgcactggatgttctccagatataagctgaaatatctcgatgatccgaaacaatcttatggcagcgcagaggaaatccatacgatcacacgcaaaggcttcagcaaagagcagccgaatgccgcaaagcttctgagccagtttaaatggacgcaagacgaaatgggcgaaatcatgatcaaggtggaagaaggcgagaaacctgccaaagttgctgctgagtacgtcaataaacacaaggatcagattgccgaatggacaaaaggcgttcaaaaggtgaagggagacaaaatcaaccttgcctatgtggcgtgggacagtgagattgcaagtacaaacgtcataggcaaagtcttagaagacttgggctatgaggtaacacttactcaggtagaggctgggccgatgtggactgcaattgcgacgggaagtgcggatgcatcactttccgcatggctgccgaatacccataaagcatacgccgctaaatataaaggcaaatatgacgatattggcaccagtatgactggtgtgaagatggggcttgttgttcctcaatatatgaaaaatgtcaactcaattgaagatttgaagaagtaatcaaaaaagcagcctgtgtcaggctgctttttttgcgttattttacgtaagcggcagcgggtgaatcagccttttgaaaagtttttaatacggcattcgctaaaatatgaatgccggtaaacatcgcgtttcggtcaaaggtcatgtgcggatgatggagccccggctggagcccgcagcctagtccgagcatcgttgttttcagattcggcaccttcacggcgtaaaaatggaaatcctctccgccggtagtgacaagcgggtcatcaagccgctcagccccgatgatatctgtaatggcttctgccatgatcgcttcagcttctttgttttgtgttgccgcaggaaggctgtgttctttttgcagctcgatttttgcgccgaatgcagcggcggccgcttcacaggctctttctgtctcggcgattaacgcctccatggcttcattggtctgtgcgcgcaaatcaaggctgaacgatgcttttcctggaatgatgttagagctttcaccgccggcttgaagttttgtcattttgacggtatgcgggatttgcgggtcaatatgaatgagtccgagcttatgtacaagaaatgccgcaatttcaatgctgttttttccgagatgcggacgggcgccatgagcctcttccccgatgatcgttccctcaatgtgctggcttgatccgtgcagaatagacggagcgcagcggccgttctgtgtttcctgaatcgggcggacgtgaacgccatacaaatagtcgatatcatcaagcacgccttcttctatcattttcaaggcgccgccgcctttttcttctgccggctgaaagataaaacggattgtgcccttcggaagctcaggttgtttttttagcagcattaatgtgcccaatgccattgtcatatgtgaatcgtgtccgcaggaatggttggcgcgaaatgtgccgttaacctcctgccacagcgcgtcaatatcagcgcgtaccgctacaacaggtgagcctgagccgatttcgccgacaaccccggtgcagtctgaaaacgtgcgcgtccggcaccctaaatcctcaagcttttgtttcaaaaatgaagttgtctcatattccttccagctgacttcagggttcgcgtgcagatgctcgaagatgtccataatggtttgtttcatgtcttctgaaagcttttgcatggtaagaaatacctccttctatcagaatgaatttttaccttctttactttatttatattgaaacaggaagataggctgtatataatatagcacatattgctactattcagaataattaatattttcaaacagaggggatggatcgaaatatgagtatgccagcagccgaaacacagcctaagaaaaaacgaatgacatttaaaatgcctgacgcttatgtcctcttatttatgattgctttcatttgcgcaatcgcttcatatattgtgccggcaggtgaatttgaccgcgtgacaaagggggatgtcacgaccgctgttccgggaagctatcattccattgaacagtctccggtcagcttgatcagcttttttacttctctacaggatggaatggttggatcagcacccatcatctttctgattctattcacaggcggcaccattgctattctagaaaaaacgggtgccatcaatggcctgatttacaatgtcatcagcaaattccgcacaaagcaattattatttatttgtattgtcggcgcattgttctccattctcggaacaaccgggattgtcgtgaattcagttatcggttttatccccatcggcctcattgtggcacgatccttaaaatgggacgcagtcgcgggagccgctgttatatacatcggctgctacgctggatttaactccaccatattatcaccgtcaccgctcggtttatcacaatcaatcgcggagctccctcttttctcaggaatcggcctgcgagttgtgatatacatatgctttttgctgtcttctattatttatatctatttgtatacgagaaaattaaaaaaatcaaaagatgccagtgtgttaggaacagattggttccctgcggcaggaatgggcgaagccggtaaagaagaagatcagtcagtgccgtttaccgttcgccataagctgattttggctgtggcgggactctcacttgtcggatttttatacggcgctttgaagcttggctggtcagattcccaaatggctgcgacatttatttttatttctgtccttgccggtttaataggcgggcttgcggcgaacgatattgccaaaaccttcattacgggctgccaaagtcttgtatacggggcgctgattgtcgggatggcacgaagcatttccgttatccttgaaaatggaaagcttctcgatactgtcgtcaatgctttggcttcacttttggatggattcagcccgattgccggggcaatcggcatgtatatcgccagtgcgctgcttcattttctcatctcttcaggttctggcgaagccgttgtatttattccaatactggcgccgctcgctgatttgatgggaatcacgagacaggttgcggtggaggcagttatgcttggagaaggggtcgtcaactgtgtgaacccgacatccggcgttctcatggcggtgcttgccgccagcggtattccgtatgtcaagtggctgcggtttatggtgccgcttgctctgatttggttcttgatcgggcttgtctttatcgtgatcggcgtcatgatcaattgggggccgttttaacgattgctgcccgccggcttgtacggcgggcttttgagttattcattgcagaagcgcaggctgttattgtaacatgtaagccataagccattcgtaaaagtgcgggaggaaggtcatgaataatctgcgtaatagactttcaggcgtgaatgggaaaaataagagagtaaaagaaaaagaacaaaaaatctggtcggagattgggatgatagcgggagcatttgcgctgcttgatgtgatcatccgcggcattatgtttgaatttccgtttaaagaatgggctgcaagccttgtgtttttgttcatcattatcttatattactgcatcagggctgcggcatctggaatgctcatgccgagaatagacaccaaagaagaactgcaaaaacgggtgaagcagcagcgaatagaatcaattgcggtcgcctttgcggtagtggtgcttacgatgtacgacagggggattccccatacattcttcgcttggctgaaaatgattcttctttttatcgtctgcggcggcgttctgtttctgcttcggtatgtgattgtgaagctggcttacagaagagcggtaaaagaagaaataaaaaagaaatcatcttgaaaaatagatggtttctttttttgtttggaaagcgagggaagcgttcacagtttcgggcagctttttttataggaacattgatttgtattcactctgccaagttgttttgatagagtgattgtgataatttaaaatgtaagcgttaacaaaattctccagtcttcacatcaggttgaaaggaggaagcggaagaatgaagtaagagggatttttgactccgaagtaagtcttcaaaaaatcaaataaggagtgtcaagaatgtttgcaaaacgattcaaaacctctttactgccgttattcgctggatttttattgctgtttcatttggttctggcaggaccggcggctgcgagtgcagaaacggcgaacaaatcgaatgagctaacagcaccgtcgatcaaaagcggaaccattcttcatgcatggaattggtcgttcaatacgttaaaacataatatgaaggatattcatgatgcaggatatacagccattcagacatctccgattaaccaagtaaaggaagggaaccaaggaaataaaagcatgtcgaactggtactggctctatcagccgacatcgtaccaaattggcaaccgttacttaggaactgaacaagaatttaaagaaatgtgtgcagccgctgaagaatatggcataaaggtcattgttgacgcggtcatcaatcataccaccagtgattatgccgcgatttccaatgaggttaagagtattccaaactggacacatggaaacacacaaattaaaaactggtctgatcgatgggatgtcacgcagaattcattgctcgggctgtatgactggaatacacaaaatacacaagtacagtcctatctgaaacggttcttagaaagggctttgaatgacggggcagacggttttcgatttgatgccgccaaacatatagagcttccggatgatgggagttacggcagtcaattttggccgaatatcacaaatacatctgcagagttccaatacggagaaatcctgcaggatagtgcctccagagatgctgcatatgcgaattatatggatgtgacagcgtctaactatgggcattccataaggtccgctttaaagaatcgcaatctgggcgtgtcgaatatctcccactatgcatctgatgtgtctgcggacaagctagtgacatgggtagagtcgcatgatacgtatgccaatgatgatgaagagtcgacatggatgagcgatgatgatatccgtttaggctgggcggtgatagcttctcgttcaggcagtacgcctcttttcttttccagacctgagggaggcggaaatggtgtgagattcccggggaaaagccaaataggtgatcgcgggagtgctttatttgaagatcaggctatcacagcggtcaatagatttcacaatgtgatggctggacagcctgaggagctctcgaatccaaatggaaacaaccagatatttatgaatcagcgcggctcacatggcgttgtgctggcaaatgcaggttcatcctctgtttctatcaatacgccaacaaaattgcctgatggcagatatgacaataaagctggggcaggttcatttcaagtgaatgatggtaaactgacaggcacgatcaatgccaggtctgtggctgtgctttatcctgatgatattgcaaaagcgcctcatgttttccttgagaattacaaaacaggtgtaacacattctttcaatgatcaactgacgattaccttgcgtgcagatgcgaatacaacaaaagccgtttatcaaatcaataatggaccagagacagcgtttaaggatggagatcaattcacaatcggaaaaggagatccatttggcaaaacatacaccatcatgttaaaaggaacgaacagtgatggtgtaacgaggaccgaggaatacagctttgttaaaagagatccagcttcggccaaaaccatcggctatcaaaatccgaatcattggagccaggtaaatgcttatatctataaacatgatgggggcggggcaattgaattgaccggatcttggcctggaaaaccaatgactaaaaatgcagacggaatttacacgctgacgctacctgcggatacggatacaaccaacgccaaagtgatttttaataatggcagcgcccaagtgcctggccagaatcagcctggctttgattacgtgcaaaatggtttatataatgacgcgggcttaagcggttctcttcctcattgagggcaatgctagaggggacttaccgaaagaaaccatcatagatggtttcttttttgttcataaatcagacaaaacttttctcttgcaaaagtttgtgaagtgttgcacaatataaatgtgaaatacttcacaaacaaaaagacatcaaagagaaacataccctggaaggatgattaatgatgaacaaacatgtaaataaagtagctttaatcggagcgggttttgttggaagcagttatgcatttgcgttaattaaccaagggatcacagatgagcttgtggtcattgatgtaaataaagaaaaagcaatgggcgatgtgatggatttaaaccacggaaaggcgtttgcgccacaaccggtcaaaacatcttacggaacatatgaagactgcaaggatgctgatattgtctgcatttgcgccggagcaaaccaaaaacctggtgagacacgccttgaattagtagaaaagaacttgaagattttcaaaggcatcgttagtgaagtcatggcgagcggatttgacggtattttcttaatcgcgacaaatccggttgatatcctgacttacgcaacatggaaattcagcggcctgccaaaagagcgggtgatcggaagcggcacaacactagattctgcgagattccgtttcatgctgagcgaatactttggcgcagcgcctcaaaacgtgcacgcgcatattatcggagagcacggcgacacagagcttcctgtttggagccacgcgaatgtcggcggtgtgccggtcagtgaactcgttgagaaaaacgatgcgtacaaacaagaggagctggaccaaattgtagatgatgtgaaaaacgcagcttaccatatcattgagaaaaaaggcgcgacttattatggggttgcgatgagtcttgctcgcattacaaaagccattcttcataatgaaaacagcatattaactgtcagcacatatttggacgggcaatacggtgcagatgacgtgtacatcggtgtgccggctgtcgtgaaccgcggagggatcgcaggtatcactgagctgaacttaaatgagaaagaaaaagaacagttccttcacagcgccggcgtccttaaaaacattttaaaacctcattttgcagaacaaaaagtcaactaaccgcaactttagagtaaagggctgattgtcaatgtgggagcagttgtatgatccgtttggaaacgagtatgtgagcgcacttgtggcgctcactccgattctcttttttcttttggctttaactgttttgaaaatgaaaggcattcttgcggcatttcttaccctagccgtcagtttcttcgtctccgttttggcatttcatatgccggttgaaaaagcgatttcttctgttttgttaggaatcgggagtgggctgtggcctattggctacatcgtcctgatggcggtgtggctgtataaaatcgcagtgaaaaccgggaaatttaccattattcggtccagcattgccggcatttcgcctgaccaacgattacagctattattaattggtttttgttttaacgcgtttttagaaggcgcggccggttttggtgttccgattgcgattagtgcggcgctgctcgtcgaacttggttttaaaccgttaaaagcggcagcgctctgcttgattgcaaacgcagcctccggagcctttggggcgatcggaattcctgtcatcacaggggcgcagattggtgatttgtctgctcttgagctgtcacggacattaatgtggacactgccgatgatctcatttttaataccattcctgcttgtattcttattagaccgaatgaaaggaatcaaacagacatggcccgctcttctggttgtgagcggtgggtatacagcggttcagacactgacaatggcggtgctcgggccggaattagcaaacattttggctgccttattcagcatgggcgggcttgccctcttcctccgcaaatggcagccgaaagagatttaccgcgaggaaggggccggcgatgctggtgagaaaaaggcataccgtgccgctgacattgcgaaagcgtggtctcctttctacattttaactgcggcgatcaccatctggagccttcctgccttcaaagcgcttttccaagaaggcgggctgttatatcaatcaacgctcctgttcaaaatgccttttctgcatcagcaaattatgaaaatgccgccgattgcgccatctgccatgccgttagatgcagtctttaaagttgatctgctgtcagcgactggtacagcgattttagcggcggtcatcgtgacagggctgttcagcaaaaagttctcctcccgggatgcctttgcttccctgaaggagacaggaaaagagctgtgggtgccgattatgacgatctgcttcgtgatggggtttgccaatctggccaacttcgcagggctcagctcttcaattggattagcattggcgaaaacaggagacctgttcccgtttgtcagtcctgttcttggctggattggcgtgttcattactggttctgttgtcagcaataatgctttgttcggtcatttgcaggttgtcaccggagcgcagatcggtgcgggttcagacttgctgttagccgcaaatacggcgggcggtgtcatggcgaaacttgtttctcctcaatctatcgccatcgctgccgcagcggtcggccaaacaggcaaggaatctaaactgtttaaaaagacagtggcgtacagcctgattctgttagtgattatttgtatatggacgtttattcttgcaagatttggagtgtaatagaaaagagcagtacatgcccagcatgtactgcttttttatgttaatttgctttctttgtcatttcggctgttgttttcactctggctttccccataaataaaatggtaaccgccgcgaggacaattggaatcaaagcgagcaaaaacacatacgtaatacttgatgacatcgcgtcaataatgcgattcaggatcgcatcaggaatctgggaacgtgttccagcttggaatatctcctgcgggtcgccaatattttgcgcagcacctgatcccgctgagcctttcatcccgctgaaggcgtcggtcagcttgttcgtgaatacgtttgtttgcaccgttccgaaaatggtgacgcctaaggtcatgccaaatgatcgcaaaaatgaatttgtagagtttgccgttccccgaaagcgaggttcaagatcattcatcgatgccgccggcagcagggagaagttaaagcctacaccaaagcctgaaatcatcataaagactgtcagccatacccgtgctgtgtcaggcgtcatattggaaagaagcagcatgccgataaagaaagctataacagatatcagcatcaaattgcggaagcttgccttcgtttggaagatcccgccgatcatgcttccgatgactgatccaatcatcatcggcgtcagaatgaagcccgcgcttgtcgccgagctgccgtagaccgcctgaacgaaaatcggaataaataccgctaaaataataaatgttccgccatacaggaaagcgagaatctgtgctgtggcaaacaagcggttcttaaacatccagaaagaaataatcggctcttctgcttttctctccacaataaaaaaggcaatgaagaaaacggcgaatacaataaacagcccgatgatctgaatggaattccaatcgtatgttttgccgccaagctcaagggcgaacatcaggcatacaatggatacgactaaggtaatcgcgccgccccagtctattttctgctttctgtgctccagagattctttgtagtagcgaataatgaaaaacaatgacaatgcgccgatcggcacattgatgtaaaacacccagtgccagctgatcgaatctgtaatgatcgcgcctaagagcggaccaagaacactggataatccaaatacagcaccgaacatgccggacatttttccgcgtttttccggcggaaacaaatcaaagataatggtaaaggcaatcggcaggagcgcgccgcctccgatcccttgaatggcccggaagatgatcagctgattcatcgtctgggcaatcccgcataaagcagaaccgattaagaaaaaaataagtccaaacaggaaaaaacgttttcggccgtacatatcggaaagcttgccgtaaatcggcatgccagccataaccgccaccatataggatgccgtcacccatgcaaatttatcgaaacttccaagatcggctacgatattgcccatcgcggtggcaacaatcgtattgtccattgcagacatcaagatgcccagcaggagaccgaggaccacaaatttggtggaagcctgttttgctgttgttgtgtccatttgttctacctcctcttacttttctatgtaagttctgatatcatgataatagtttgattgttgaatatctcgattatcaagataaactcgattttatagggaggactgtcagttgtcaacaagaaattccagaagtgagttggaaaagactgctgttcagctttttcgaaaactgggcacaagaacggttctgtttcatcaggcagccgctcaagctctcggtctgtttcccaccgatttgaaatcagctgacattttaaatgaagcagggccgatgacggccggagaactgggaaaaaaaaccggcctcagcacggggtcagtcacggcgcttgttgaccggctggaaaaagcggggtatgtggctcgtgaaaaggacccgaatgatcgcaggagagtcgtaatcgtccctttgactgcttcgaaaaaacatataaaggatttgttccgtcctctgtctgagtcaacgatggatttgtgccgcgaatatacggaagaggagctggaactcattttcagttttgtaggcaaagccgccgatattatggaggaagagcttgaacgtctgaaacagtaagtgaatttgtgcatagcttggcccgttcccgaataaattgtacaagttacataagagaagggagtacgggccggtgaacatttttttgagctatattgtgctgggactgtccttgtctgcgcctgtggggccagtgaatgcggcgcaaatagacaaaggaattaaaaacggtttttggcatgcatggattttcggtttaggcgccatgacagcggatgggctgtacatgctttttatctatttcgggctgtcacagtttttgaccgctccatttgtgaaaacgtttttgtggctcttcggcttttttgtcctgacctataccggaattgaaacgcttaaaaacgtcagagaaccgatggatgtgcgaagctcgcgggggaaaccgtcatacaggaaaacattcgcatcgggttttctcatttcattgtcaaacccattgagcatccttttttggcttggaatttacggaagcattcttgcgaaaacagcagaggcctacaatatgaatcagcttctaatctatagctccggcatcatgatcggcattttaatctgggatttctgcatggctatcacagccagtacgttcagaaacctgcttcatgaaaagctattgagaggattgaccggaatcgccggtgtatccctccttgtgtttggcttttactttggttatcagggcatcaaacagttattgggctgattcatgaaggacagtcacctgccgcttccagttttaatatagtatccagatgatactggaggtggatcaatggtgaatgggatttacaccaaaagttttctggaacgtattcaggaagagcttcctgaatggcaaagaatcgcttttgagctgctggcagaaactctgggggacgacgcggatacgtttccgtgcattcccggacgccaggcgtttctgactgatcagcttcggattgcttttgccggagatccgcgggaaaaccgcacagcggaggaactggctccgttgcttgcggagtacggcaagatatcgcgggacacgggaaaatacgcatccctcgttgtgttgtttgatacaccggaagatttggcggagcattattcgattgaagcgtatgaagagctgttttggcgctttttaaatagactgagtcatcaagacgaaaaagaatggccggaagacattccggccgatcccgagcattataaatgggagttttgttttgacggcgagccgtactttcttctctgcgctacaccggcgcacgaggcgagaaaaagccgaagctttcctttttttatgatcacgtttcagccaaggtgggtgtttgaggacctaaatggatcaactgcatttggccgtaacatgagcaggctgatccgatctcgtttagaggcctatgatcaggctccgattcacccgcaattaggctggtacggaggaaaagataatcgtgaatggaagcagtatttcctccgtgatgacgaaaaacaggtatcgaagtgcccgttttcttatttaaagaacatgttcaacaaaatgaaataaatcaaggactggcagggcgatctttatgaccctgctttttttgatagatcatggtaacgatggcgatgatcacgagaaaacctatgctgacgaaaaaaccgggccggcttgatttttcaaacaatgtaccggacacagccgcagcaatcagaaccatcgctaaataaatttgcgtttttcccatgccctcgggatcagtcagctttttgctggagaacaggataaacagccaagtgtataaaagcataagccccgcagctgttgtcatatgctcataaatgtttttaggcagcactaacgacagaataatggagagaacaagccccgcaaacgtcagcccaagtgccggccagcatatttttttgccttcctttagagtaaagcatttcggcgcgtcgccgtcatcagccatcgtacaaagcaatgtcgtaaccgcaaatagcgaagcgacaagggtcgagaacccggcgataatgaaaatcccgttaaatatatcaaggatgatctcaaggttgtatccttttaacgacgtaatgaacgggctgtcctgttctgtaaacttgtgtaacggaaccaaaagcagagccagcccgattgaaatgatataaataatcgccagcgttgccagcatcagtttccctgatttagacgcttcctcaggtttttttaagtgaaccgccatcagccccatgacctcaatcccgccaaaagcgtaaaacgcgtagattaaacctgtccacagccccatggcgccgtatgggaaaaactcactcgtcttatttggaacatgtatgccatgatttccgccggacaggataccgcataaagccaggatggcaatgacaataaacataaaaatagcagctgttttaatgactgccagcacgttttctgttttttcaaagacggacaggccggtgaaaataataaggagccccagtactgcatagattgaggcaaacacccatagcggcacttgaggaaaccaatgcttcgtaaatagcgaaatggctgtcagctggcttccggtaatcagcatttctgatgtccagtacacccagccgttgctgaagcctgcccatttgccgaatgcttttcgggcatacgcacaaaacgagcctttttccggctgcttcgccgatagcttggcgagctgttcaaagacaaaatacgtaccgatccctgcgatcagaaatgaaaggagaacggaaaaaccgctttttacaattgcgatgctggaaccgagaaagaagcctgttccaatcgtgcagccgactccgatcagtgacagctgccaccaagccagattcccttttggctggtctttttttgtttggctcattatttattcaaccccttttatctaaggttagattgtgatctgtccaaagcttatatacatcggatttttgcctctttttacatggagaaggaagcggacgctcatactaatgaaaaaaggagcaaaccaatgacacagcaatatattgtggagccgaaaaaagggcttgggctgaagctgaaaaagggtcagattttaaaggtggttgatgtagaagggcagcaggtggctgattttgtcgcataccatgccaaggatttttatgaacaccttgatcagggagcgacgatagacgccaatcactccattcatgtgaaggtcaacgaccatctctactccaacctgtataagccgatgttaaccctgattgaagatacggtcggcaagcatgatctgctgttgcccgcctgccgtcctgatatgaacaggctcttatatgggaagcaaaaggatgagtttcaggatacgtgctatgacaatatgaaccgtgcgcttgagcagtttggcgtaccgaagcctcacatgcattacccatttgcgatttttatgaatactgtccttgatgagaaagggaatctgtctgtggaaacgccgctttcgaatgccggagattatgtaaggctcagggcggagatggatttaattgtcgcgttttcttcctgcccgattgaaaaagggaaatgcaatggcgacagtgtgacatccatacgggttgaagtcagctgatctctcttgttcactgtgaatgaagacctgtgctatatttaatagggatacataacagtcatgattcattttcattgatttggggaaatgatcagtaacaagggaaaatgtacaggaggaatgattgggatgagcatgcaggaaaagattatgcgtgagttacatgtgaagccctcaattgatccaaagcaagaaattgaggaccgagtcaattttttaaaacaatatgtaaagaaaaccggtgctaaaggctttgtattgggaatcagcggcggccaggattcaacacttgcgggaagactcgctcagcttgcggtggagagcattcgcgaggagggcggagacgctcaatttatcgctgtccgtcttccgcatggcacacagcaggatgaagacgatgcccagcttgctttgaagtttattaagccggataaatcatggaagtttgatattaaatcgacagtcagcgctttttctgatcagtatcagcaggaaacaggcgatcagctgactgactttaataaaggaaacgtaaaagcaagaacaagaatgatcgcgcaatacgcgatcggcggccaggaaggccttcttgtgttaggaacagaccatgctgctgaagcagtgactggtttctttacgaagtacggtgacggcggagcagacctcctgccgctgacaggcttgacgaagcgccagggaagaaccttgctgaaagagctgggtgcaccggaacgcttatacttaaaagaaccgactgccgatctgctcgacgaaaaaccgcagcagtcggatgaaacagagcttggcatttcctacgacgagattgacgattatctcgaaggaaaagaagtatcagcgaaagtatcagaagcgctggaaaaacgctacagcatgactgaacataaacgccaggttccggcgtctatgtttgatgactggtggaaataagttgaagaaagcccgctctcggagcgggcttttgtcgtgtacagaagctttatttgatgcggatatgattcagcttgaccattaatctgtcggcgaaccttcggaggctgcctctcgtatcaggatctaatgggagttcggctctcgcggcaatgttctctgccacatcctgaatcgacaggttgtctgtttgaatgtggtcctcaaaaatgggtgatgataaaccttcaatgcagcggtcaatttgtttggcggcccaggagttttttccttctgctctggtgcgcagcctttttaacaaggtttcctttgaagccattagtgtaaagtggtgaacgatcctgccttcatgcctgagcctgccgatgatctcattgaagtattcaggatgtacaatcgtcataggcacaataatgatgccgcggtatgtatctgtcagagaagctagaaaactgtaattgaacgcccgccataagggatagctttgaaaatcgtcctttgcgatctcctgcggcaccatggagcgcagcgcaaaacccattttctcgggatcatacacgtaagatgggtttagccttctgtgcagttcgaaggctgtttgtgtttttccggaaccgaatgccccgtttatccaaatgatcatcgccatttctcccttcctattcatcatacagaaaaagacccttcaatcgaagagtcagctggaaaaacaataaaggcggaaggttttaacgcttttttgcgtcgaagtattaaaatacctgcagaaatgttgtacaatgaatgtcattcaggcaaaaatggctaaacaacaaagcgcactttaagcttggaccggtaaagccggtatctatataaatattcgttaaataagcatataatgaagataaaatttcattccttaggaggatttcgccgaagatgaacgctaaacgagccatcccagtaagagaaagaaatatcgtcctgatcggattcatgggtgtaggaaaaacaacaatcggccaattggtcgctaaaaaattatatagagattttattgatattgaccaagagatcgaaaaggatttcaatatgacaattcctgagatatttgagaaaaagggagaagactttttccggaaaacggagaaggaatatattttagacatctgccatcataaacgattcaaagtcgtatctctgggcgggggatcttttaaacaagaagaaatcaggaattgctgtctggaaaactgtctcgtgcttcatctggacctgtcatgggagaactggaagcagcgcgcggatttattgatcgaaagccgccctgtactgcataaccgttcaatggatgaaatggaacagctgtttaacgaaagaaaagtcatttatgacaagcacaattcaaaagtggcaacagacaacctttccccggaagaggttgccgattacattgttgagacattaaaaattggctgggatctttatcagccgatgtaaaaagccgtgcgcagcgcacggctttttttatcgttttatcccttgtatcaaaatcgcttttaaacaaaaggagatgggctgtccgttttggttcaatgtaatacagaacgtgtcgcgtgcttcgtctgatgcgtgattcaagtgggtaatgatttgtttttctcggtcagcgggggttccgcctcgtttgatccagctatcgtattgaatcggcaagttccacttttggatgtcttgataggccagttgattggcgctgaacatcgactgccattctgataatgagctttctcgaacatgggaagggtctcgaagccggttcaaatgattgacaaactcatcaagaatgggatcttcaggcgcgtaatgatcaactaagagaaaacgtccgtcctcttttagtacgcgtgcaacctcgctgacagctttgcggacatctgaaaaatggtgggctgcgtatcggcaggtgatgatgtcaaatgaatcgtcggggaaggggagtgactctgccgttccttgctgaaagcgtacgttttcagctcctttttcttgcgcgaaggaggacgcaacctcaaccatctctttcgtcgcatcaacaccgatgcactcctgtacataaggagaaaatgccagggccgtatggccggcgcccgctccgatatccagcacccgatgctctgcccggcattccgctgttttgatcatcaaccccaaatcttccccctcggcaaataccttttcatcccgatacatctcggcgtttttagaaaacggtgtttcattagtcatttgaaccagctccttcttttcgtaaatgatgatatggattatgttagcaatttctgttatgattcgtccaagatataaaaatgatgaaaacgataggttcaacctatggaggctgaaatggatattaaagtgatggaatatgcagcggaaattgcccagcgccaaagctttacaaaggcggcggaacatcttcatatcgcacagccgtctctcagccagcaaatcaaaaagcttgaggctgagctagggcttaccctttttcacagatcccatggctctgttacattgacaccccacggcaggcgtttcattgaaaaagccgaggacatcattcgttccagagatgatttgcttcgggaaatgcaggagcgatcacagggaatcggtcataaattatccatcgggattcctgctgtaacagggagatatctctttcctccgctgctgaagcagtttttggcgcgctatcctcatgtggaggttcagcttgttgaaaaagattcggtttcattagaggagatgacggcaaagggagaagttgacctttctgttttatccttgcccatcgaggatgaacggctctccattatacccttgctcacggaaccagttgttctcgcagtgccgaaggaaaaacaaaggtggatgccgccggaaatggtcgcgctgattgagaaagcgctggaagaagatgagggacaccagccgtgtgtgccgcttgacatggtaaggaacgtgccatttattctgttaaaagaaggcttcggctttcgcaggacagttctcgatctctgtgcggaaagcggctttaagccgaatgctgcctttaagacaagccatattgaaaccgcccaatctcttgtggctaacggattaggtgtgacaatggcaccgaatatggtcagaagggataaagatccgggtgtgatctatttattgattcaatccgcgccatcacgaaccctcgtcttcgtctttttaaagaaccgctatgtcagtctgaccgcccaggcctttatggaactaacccgggaaagtcttaaacaaacgtttgatgaaggctgtctgggaaacaaagatgaaaatatttagaaaacaaagccgaaacgtggtagtataggaatacaaactaaatcttataaaacaaaggggaataatcggaaatgcaactattcgatctgccgctcgaccaattgcaaacatataagcctgaaaaaacagcaccgaaagatttttctgagttttggaaattgtctttggaggaacttgcaaaagtcaaagcagaacctgatttacagccggttgactatcctgctgacggagtaaaagtgtaccgtctcacatataaaagcttcgaaaacgcccgcattaccggatggtacgcggtgcctgacaaggaaggcccgcatccggcgatcgtgaaatatcatggctacaatgcaagctatgatggtgagattcatgaaatggtaaactgggcactccatggctacgccgcattcggcatgcttgtccgcggccagcagagcagcgaggatacgagtatttcaccgcacggtcacgctttgggctggatgacgaaaggaattcttgataaagatacatactattaccgcggtgtttatttggacgccgtccgcgcgcttgaggttatcagcagcttcgacgaggttgacgaaacaaggatcggtgtgacaggaggaagccaaggcggaggtttaaccattgccgcagcggcgctgtcagacattccaaaagccgcggttgccgattatccttatttaagcaacttcgaacgggccattgatgtggcgcttgaacagccgtatcttgaaatcaattccttcttcagaagaaatggcagtccggaaacagaagtgcaggcgatgaagacacttgcatatttcgatattatgaatctcgctgaccgagtgaaggtgcctgtcctgatgtcaatcggcctgattgacaaggtcacgccgccgtccaccgtgtttgccgcctacaatcatttggaaacagagaaagagctgaaggtgtaccgctacttcggacatgagtatatccctgcttttcaaacggaaaaacttgctttctttaagcagcatcttaaaggctgataaatgtgaaaagccgccgcatatcatcaggcggtttttttctgcaaactgccggaatgagaacagactggagacgaatagatatgaaacaaagaatcattgatgaattaaaacggatcgagcagtcatacggagtcaaaatcgtgtatgccgtcgagtcaggaagccgcgcatggggatttccctcgcaggatagtgattacgacgtccgctttatttatgtgccgaaaaaggagtggtatttttcaattgagcaggagcgtgatgtcattgaggaaccgattcacgatttgctggatatcagcggctgggagctgagaaaaacgcttcggcttttcaaaaagtcaaaccctccgctcctcgaatggctgtcctcagacattgtgtattacgaagcatttacgaccgcagagcagttaagaaaactgcgcacggaggcatttaagcctgaagcaagcgtgtatcactatatcaatatggcgagaaggaacgtcaaggattatctacaaggacaagaggtcaaaattaaaaagtacttctacgttcttcggcctattttggcctgccaatggattgaaaagcacggaaccataccgccaatggactttactgttttgatgaatgaacttgttgctgaacccgagctgaaggctgaaatggaaaccttgcttgaacggaaaagaagaggagaagagcttgacctcgaagcaagaatcaatgttattcaccaattcattgaaacggaaatcgaaagaatcatggaagcggcaaaagaactgaaggcagagaaaaaagatatgacacctgagttgaaccgtttgcttttgaatacggttgaagaagtgtggaaggatggaggaagctgatgttttttgtcgcttccttttctcctttattcgacagaatcccccccgactttctaactatctgattgtgacaaacccacaaaaataatcagaatctttgtattttgagaatattgtgaacgtcggttttgtccatttacaataaactcatacaaatacttcttagattgcggggtgttgaggttggaagtgatcacaagagattttttcttatttttatccaaaagcggctttctcaataaaatggcgaggaactggggaagccgggtagcagcgggtaaaattatcggcgggaatgactttaacagttcaatcccgactattcgacagcttaacagccaaggcttgtcagttactgtcgatcatttaggcgagtttgtgaacagcgccgaggtcgcacgggagcgtacggaagagtgcattcaaaccattgcgaccatcgcggatcaggagctgaactcacacgtttctttaaaaatgacgtctttaggtttggatatagatatggatttggtgtatgaaaatatgacaaaaatccttcagacggccgagaaacataaaatcatggtcaccattgacatggaggacgaagtcagatgccagaaaacgcttgatattttcaaagatttcagaaagaaatacgagcatgtgagcacagtgctgcaagcctatctgtaccggacggaaaaagacattgacgatttggattctttaaacccgttccttcgccttgtaaaaggagcttataaagaatcagaaaaagtagctttcccggagaaaagcgatgtcgatgaaaattacaaaaaaatcatccgaaagcagctcttaaacggtcactatacagcgattgccacacatgacgacaaaatgatcgactttacaaagcagcttgccaaggaacatggcattgccaatgacaagtttgaatttcagatgctgtacggcatgcggtcgcaaacccagctcagcctcgtaaaagaaggttataacatgagagtctacctgccatacggcgaggattggtacggctactttatgagacgccttgcagaacgtccgtcaaacattgcatttgctttcaaaggaatgacaaagaagtaaaaaaggagagattatcatgacaacaccttacaaacacgagccattcacaaatttccaagatcaaaacaacgtggaagcgtttaaaaaagcgcttgcgacagtaagcgaatatttaggaaaagactatccgcttgtcattaacggcgagagagtggaaacggaagcgaaaatcgtttcaatcaacccggctgataaagaagaagtcgtcggccgagtgtcaaaagcttctcaagagcacgctgagcaagcgattcaagcggctgcaaaagcatttgaagagtggagatacacgtctcctgaagagagagcggctgtcctgttccgcgctgctgccaaagtccgcagaagaaaacatgaattctcagctttgcttgtgaaagaagcaggaaagccttggaacgaggcggatgccgatacggctgaagcgattgacttcatggagtattatgcacgacaaatgatcgaactggcaaaaggcaaaccggtcaacagccgtgaaggcgagaaaaaccaatatgtatacacgccgactggagtgacagtcgttatcccgccttggaacttcttgtttgcgatcatggcaggcacaacagtggcgccgatcgttactggaaacacagtggttctgaaacctgcgagtgctacacctgttattgcagcaaaatttgttgaggtgcttgaagagtccggattgccaaaaggcgtagtcaactttgttccgggaagcggagcggaagtaggcgactatcttgttgaccatccgaaaacaagccttatcacatttacgggatcaagagaagttggtacgagaattttcgaacgcgcggcgaaggttcagccgggccagcagcatttaaagcgtgtcatcgctgaaatgggcggtaaagatacggttgttgttgatgaggatgcggacattgaattagcggctcaatcgatctttacttcagcattcggctttgcgggacaaaaatgctctgcaggttcacgtgcagttgttcatgaaaaagtgtatgatcaagtattaaagcgtgtcattgaaattacggaatcaaaagtaacagctaaacctgacagtgcagatgtttatatgggacctgtcattgaccaaggttcttatgataaaattatgagctatattgagatcggaaaacaggaagggcgtttagtaagtggcggtactggtgatgattcgaaaggatacttcatcaaaccgacgatcttcgctgaccttgatccgaaagcaagactcatgcaggaagaaattttcggacctgtcgttgcattttgtaaagtgtcagactttgatgaagctttagaagtggcaaacaatactgaatatggtttgacaggcgcagtaatcacaaacaaccgcaagcacatcgagcgtgcgaaacaggaattccatgtcggaaacctatacttcaaccgcaactgtacaggtgctatcgtcggctaccatccgtttggcggcttcaaaatgtcgggaacggattcaaaagcaggcgggccggattacttggctctgcatatgcaagcaaaaacaatcagtgaaatgttctaagcgggactaaatgggcatcctccctgcgggggtgtccatttcatccatatactataaaaaagaggaggaagtgccatagaaaacacacagctgattatttcgatttgtatttatatggcgggaatgctgctaatcggctactttgcttacaagcgtacgtcgaatctgacggattatatgctgggaggacgctctttgggtccggcagtaaccgctctcagtgccggcgctgccgatatgagcggctggctgctaatggggcttccgggcgccatgttttctactggtctgagcggcgcttggatcgtcatcggactttgccttggagcgtgggcgaactggctttacgtcgcaccgcggctgagaacctatactgaaaaagcggggaattctattacaattcccggattcctggaaaatcgcttcggagatcaaacaaagcttctcagactgttttcgggaattgtcattttagtctttttcacgttttatgtatcgtccggaatggtgtccggcggcgttttattcaacagcatcttggggatggattatcacactggcctgtggattgtgacgggtgttgttgtggcatataccctgtttggcggctttttggcagtcagctggacagattttgttcaggggatcattatgtttgccgcactcattcttgtgccgatcgttacgtttttccacacgggaggagcaggtgatacagttgctgaaatccgctctgtagatcctgatatgtttaatattttcaaaggaacgagcgtccttggcattatttctttgtttgcctgggggctgggatactttggccagccgcatattattgtgcgttttatggcgataacgtccgtaaaagagatcaaaagagcgcgcagaattgggatgggctggatgattttgtctgcagtaggcgcagtgctgaccggtttgggcggaatcgcttattaccatcagcgcggcatgacactgaaggacccagagacgatttttattcaattagggaatatcttgttccatccgattatcacgggttttctgatttcagcgattttggccgcgattatgagtacaatttcttcccagctgcttgtgacatcaagctctctggtagaagatttgtataagtcgatgttcagacgctcagcttcagataaagaactggtgtttttaggccgactggctgttctggctgtttcaattgtcgcgttggttctggcttgggagaaaaataacaccatccttggattggtcagctacgcgtgggcgggcttcggtgcatcattcgggccggttgtactgctcagtctgttttggaaacgaatgaccaaatggggggcactcgccggcatgattgtgggagcagcgactgtaatcatttgggcgaatgccggtctttcggactttctgtatgaaatgatacctggttttgctgcgagtctattatccgtcttttttgtcagcatattgacgcaggctccgtcacaagctgtcacagaccagttcaacgactaccaagatacaatgtcacaataaagatcgaaaggaggaggaaggggctgtccctttttcctcttttctccttttaagcggccatttttttcttttggaaacaaacgtatttttttctatacaaaaagaccccgtatggatatgattaaagtaaaaaaagtataggagaaaaaggtatggaagagcttttagagagagttttttcattttcagatgttgataagctgattgattttattagctatgaactgcaaaagccagtgatactggaaagcgcggatttctttttgttagcctataattcttactatattaaccattttgattctgccaaccagcagactattttttcgaaaaagtgtccggtccagatttttgagaggtttctgaaggacggaattattgaaaaattgaaaacagagcctgagccttttcgcgtcaataaaattgaaagcattgggttaaaccagagggtggtcgtgagtgcaaagcacaaaggggaagtcatgggctacatctggattcaggagctggaccaaaatctgacggatgaagagctcgactttttgtacgagacctccttccatgtcgggaaaatcatttataaaacgaataaattgaaacaggaaaaggaagaaaaagcagaggatctcatcaaacgggcgatctatcagcaatttacctctgagaaggaactcagacgggaagctgaaaggatcaacaccgtgctgccttccatgttttcagttgttatcctgcacgccgcaaatggggatggggaagcggttgaggatttaaaggaaaatatcaggtcgtacctgaatttacgggataaggtcagtcatgtcttaacgatcgaatcaaacattgtcatcgtcgtagcgagtttttcccaaaaaagctccgtctcctcagcagcttctgagtttattaacaagctgttaacacattttcactttcaaaaaatacctacccctatttatatcggtatcggaaacgaatataatcacctattaaaacttggcaagagctacacagaagcacttgaagtcatcaaagccgcagaaatcaccggcaatcaggaaaacattccatatgaatatgccaaactcggcatttaccgctatttagaaagcatcgaacagaaaaatgaatttttagaatacgagaataaagatttagctttattaaaagcaaaagacgaagaaagcagcactgagctgctcaaaaccttggaaatctatctcctcaacaactgcaaaacaaaaccagcggcagaacagctgtttattcaccaaaatacattgaattaccgcatcaaacagattactgagatgacgtcgatcgatttaagcgatttcagaacgcggtgccagctctatctcgatttgatgctgatgaaaaagaaataaaaaagaaaccagtacttgtactggtttcgtcttcacttaaaatcctctgtaaacatacggatcatcaggttttttaatggtattccagtcagttactttgacgacagggagagttgacttgaatggctggtaatactctgaggccagagtgcccttaatgtgaatccattcatcatccttgatgtccatgtccttcggaaattccacaagcatcccgtacacgccggaatcagcgatacagtgaatgatgccaaaccttaatacgaacagctgatttttgttaattgcgtttcctttgtaagcaaatccatggaattctatcgtccgtccgagaaattcacccggatagttatagatggtttccattccttttaggaaatcgtcatcggtcagagaaatctcttttttgctggaatacttattaaacagctgtttcatttgtttgtcatagctgtcttgcgcgtaataaaggctggcatcaggccgcaaatactgtgtttgggagtaatgatctccgctctccatcgccttaaacgagaacccttttgttttgacaatggatgagtcaagcgttgcaatcgggaagaagatgcctgacaccaaaggaaaaagaaaaacaacataaatcaaataacgctgataaaatggcttgttttgttcatggtcatgctcgtgatcatggccgcacccgcaatcatggtgacccccgcttttttcaggcgacttgataaatagatatgcttggacggcggtcagaatagccagcaggaaaatcgcaataaaggatagataggaatatttcatattgatatattttgttagatttcctgaggcatgcagatgataaaagaaaaacgtaaatcccatcagcaccaataaacgaaacatccaatcacccctttaccagtagtgatcccgctaaaacaatcacgacaatatatgtaatcagcaggaaaacaaatcgttttttgaaggctgcaagcatcatcaatagattcttaatatccaccattgcgccaaagacgagaaaggcgattaacgatcctaatgaaaatgtgctgctgaaggaagacgcgatgaacgcatcaacttctgaacaaagcgacaggacaaacgccagacccatcatcacgagggaagaggatacatcattctgcccgatcgcaagcagagtggatgttttgacatacgtctgcatagcggctgcgataaaggcgccgatgattaaatatttccccacggagaaaaattcatcaatggcatgccgcaaggtcccgcccagtttttggagcaaggtgccgtgatgatggtggtggtgcccgggttcatcaggctttaaaagctggttatctttaaattgataggataaaatgaccccgatgatcagcgaaacggcgagagccagtccgcctctgtaaaagaccacgctccatctattcccgaacgcaatataagtagaaaataaaacgataggattaatgataggcgcggtcagcatgaaagcaacgcccgcatgcagaggaactccctttaacagaagccgcctcgtaatcgggatgatgccgcattcgcaggcgggaaataaaacgccggccagcgcaccgaataaaacggcgagaaaacggtttttcggcatgattcttgcaatcatttcttcagaaacaaacatttgaatgattccggaaagtatgacgccaatcagaataaacggaatggcttctattaaaatgctgataaaaatagaattcagctgaagaaaagatgattgtgctgtcacaataaaacctccgctcatgttaagctgcctttcttatgataccagaaaaaaaggcactgcttgtttgacggaggaagggaaaggatcgtttcactttggttaggattccaaaaaaccgagtaggatactgtctgtttctgcagcttcttttccgagccaaatcaggtgtccccatgagtgaagcaaacagagaacagcgccacgaatgtgctcttttgcatgatgtgcatgtgacaagtcaaccaatccatcataaacactttgcataatcagcacgggacatatgatggcttgcaggtcttttaaagagacagcggcggtttgtgacaagtcaatcagaaatccttcacccgagcgctgccggctgttcattttccgaaatgcttctatgtctttttcattcatcaaggacttgattcgctgaaacggaagcgtgctgaattgggggctcatagctcgaaacatcaaacgcgggaaagcgttattcaaggaagaaatcagcttccatatccacttttctaccggcgggcggaagagaattttccccaatttatattcagtgtcttttggggtgagccactctttggtgactgcggattgcagggtcaatgtatttactcttttcggataatgtgaggcaaagcatatgccgctcggccctcctgctgagatggcgatcacatggacactctcgatttgtagatgatctaataatttcacatagaaacggcaggcattggcaagactttttccaatttcttttgacgtccgtccatagccaggccttgaaggcgtaatgatggaatacccttgctcaatcaacgctgtgtatccgtattcctcgtaacaatttgaatgcccgccatgcatgacaaggatcggagttcccttgcctgtcacagaatattctagtgtactgccatcgaaggtgatcgtttcgactcgtcttttcatctgttactcccatttgttttttgcctattatagggttttcagcaattgaccacaaggtgaagaaatgaataaacacaagctcgtgaaatatgatatactttgtattgatattcattctcaattaaaatgatttgatatagatgtgaacgggaggcaggacggatggctgagaatcaagaggtatatgacgttacgataataggcggggggccgatcgggctgtttactgctttttactgcgggatgcgggagctgaaaacaaaggtaatcgaatttttgccgaagctcggagggaaggtgtctttattctttcctgagaaaatcattcgcgatatcggcggcataccggggattgcgggaaagcagctgatcgagcagctgaaggagcaggcggcaacgtttgatcctgatatcgtattgaatcagcgtgtgaccgggtttgaacgcctagatgacggcaccattgttctgacgggttctgaaggggagaagcactatacaagaactgtgattttggcttgcggcatgggtacacttgaggtcaatgagtttgacagcgaggatgcggccagatatgcgggcaaaaatcttcattatggagtggagaagctcgatgcgtttaaagataagcgcgtggtgatatcaggcggcggagatactgcggtcgattgggctaatgagcttgaaccgattgcggcgtctgtgactgtcgttcatcggcgtgaggaattcggcggaatggaaagcagcgtgacgaaaatgaagcaatcatcggtgcgggtgcttacgccttatcggctggagcagttgaacggagatgaagagggcatcaaaagcgtgaccgtttgtcatactgagtctggccagaggaaagacatagaaattgatgagctgatcattaatcatgggttcaaaattgatctcgggccgatgatggagtgggggctggagattgaagaaggaagggtgaaagctgacagacatatgcgaacgaatcttccgggcgtgtttgtggcgggcgacgcggctttttatgaaagcaagctgagattgattgccggcggatttacggaaggcccgacagcggtcaacagtgccaaggcttatctggaccctaaggccgagaatatggcgatgtattccacccatcataaaaaattggtgcataaataaaacagcccttgggggaaagggctgccagccatcagctgtgaaggagctttttctgcgtctgttgattctgaatgaaagctagcaattcatcctgttcttgtacagctgtgaatccataagcttcggcagctgagtcatcgcctatacagacgatagggggccggcttgctgacaattccggcgaaatgccaatttgttcgccaccattgatcaattgctgaacggacagcttgttcgggcaaatgaccatgtgcagcggggattcactgatggtacgctgaatcatgtgggtgaaccggtcatctatgacgttttcatgagtgatataaaacgaacaggattcatgcttttgcatgttttccactgcatggcggctcccgacaacaagacgtttctctgaatcaggctgaatggcggtgacaagaaagccccgtttctcaagctctgtctttgcttgctcagatgctgcactcagtttggctgtcagctggcggatgtcgattttctgagaagccagtgctctgaaaaattcacaaaccgcccggcgcgatgtgaaaaaaacgtcttcaaaggtgccaatctttcgaagaatttcttcattgacaggcatgttttcggtccgccatttcggccactcgatgagatcggcgccggaatcgcgcagcttgtctgcaagcgggtcttcatcttcgccatgagtcacaaccatcaaatgccgtccgatgagcggtttgctttcaaaccagctgtgtgtttgaaagttgacgatgtctccgatgacgataatcgcagggtttgtaatctggtgttcctgcactttttgctgaatgttctcaagtgttcctttcacactccgctggcggccccacgttccccattggatgacaatgacagggacagaaggcgatttcccgtatgaaataagctgctggcaaatataagacaagttcttgacacccatgtaaaaaacaagggtttgaacgcttcgggccagcccttcccagtcaaggttcggcgtgccttttaatgatttatcatgcgctgtaatcatggcaaaagacgatgcaaaatcccgatgcgtgacggggatgcccgcatatagcggcgctgcaattccagaggtgattcccggcaccatttcatagcgaatgccgtgctcatgaagagcatctgcttcctcgccgactctgccgaatacgctcggatctccgcccttcaagcgaacgacggttaacccatttaatgctttttcaaccagcagggcgttaatttctttttgtttcataaaatggcggtttggcagttttccgcaataaataaactggcagtccggtgatgcaaattcgagcagcttcgggttggcgagccggtcatataaaatcacatctgcttccttgagcgcctgttttcctttgatggtgagcaggcctgggtcgccgggtccggctcccacgaaatatacgattccgttcttcatgatcatgtcatccttccgtcactgtaaaaaatgaaggaccactagaaaagtgatccggtcttttgatcaatatacgagataaacatgttctccttcgatcagcgtttcatatgttttgacgcatccgtggtcaggttcttggacgattccgtcttctaaggaaattttccagtcgtgcatcgggcagaaaacatattgaccgctgacgatgccttctgccaggacgccgcccttatgcggacagcggttttcaatggcgcggatgcttccgtctgaaagcttgaaaaccgcgagctccttatcttcaatatacactgttttgcctaattgttcaggcaattcttcaatttttccgatacatacttttgttacgtctttgtttaccatgtccattcctcctcaatgatagtttttgtcattatgatgtggtcacgacattttcaaataattctttagaggtttgtttatcctctaaaaagtctttccacggatccttgtggacagagagtgtttcattcattcggccgttcagctcctgccgcttttccggatcgtttaacacggattggacatgggataaaccgacgcgctcaagccatgcggacgtacgctccagatagtttgcggtttccctgtaatattgcaggtaagcgcctgcgtattctaagacttcttcatttgttttcaccttcatcagcaaatcgccggcacgcaagtgggttccgccgtttccgccgacataaagctcccagcctccgtcgatgccgacaacgccaaggtccttaatgccggattccgcacagtttcgcgggcatgcagacacggccattttgactttgtgcggcgtgtttagcccttcgaattttttctcaagcgcaatgcccagtgccatggagtcttgtgtgccgaagcggcagaattgctcgcctacacatgttttcactgtgcggagcgtttttccgtatgcgtagcccgacggcatatcaagatcttcccataccttcggaaggtcttcttttttcacgccgataagatcaattcgctggccgcctgtcattttcacgagtgggatctcatatttgtcaacgacatcggcgatcttgcgcaaatctgtggagttggtcacgccgccgtacatccgaggaacgactgagtatgttccgtctttttgaatattggcgtgcattcgttcattaacaaagcgggatgtccggtcatcctcgtatttggttggattgatcatgcctaagtagtagttcagagccggccggcatttggaacagccttctggcgttttccagccgagcacattcatgacttctcttgtatgtgacagccctttggctttgatttcttctacgacttcatctcttgacaatgtggtgcagccgcaaatggcttctttttgcgctgacgcatcaaagtctgatccgagcgtatgctggaggatttcttctacgagtggcttacagcctccgcatgagcgggatgcgccagtgcatgctttgatctcgtccgttgacgagcagcccttttcctgtatggcttgaataatcgcaccttttgacacgccgttacagccgcagatgatttcatcgtcgctcatcgctgcggtgatgcttgtgcctgcttcttggttgagaggctgtaagattgatattttagaggtttcagagatatcggcttctttttgaatcatagaaaacaggcgattgccttcgctgctgtcaccgaataaaacagcaccgacaattttgttgtctctcaggacaatttttttatagatgccgtcctgctcatcgaagactttaatcgcttttttgtcctctgattcatcaaagtccccggcagagaaaacctcgacgcccgatacctttaactgtgtggagagaacggagccctcatacgggtttgtttcgatgccgcaaatatgcttcgccagcacttttgcctgttcatagagcggcgccacaagcccgtaggcgattcctcggtgctcggcacattcgccgaccgcgtaaatgtgcgggatttcagtctgcatataatcattgacgatgatgccgcggttaaccggaatgccgctctcggccccgagcgttgtatttgggcggatgccgacagccatgacgactaaatcagcttcaatgcttgtgccatccttgaatcggaggccttcgacacggtcgtcaccgacaatttcttctgtttgcttttcaagtaaaaaggtcataccttgtttttctaactcgttttgcagcaggcgtcctgccgttgcatcaagctggcgctccatcaggaatggggcaaggtggatgacggacacatccatgccaagattcagcagtccgcgagctgcttccaaaccaagaagtcctccgccgatgacggcagcttttttatattgttttgacgcggcgagcattgtgtctgtatcttttatgtcccggaaagctgtgacgccttttttgtctgcgcccggaatcggaaggataaaagggaccgagcctgtcgccaggatcaattcatcgtaaggctggattctgtctgcatctgtgatgactgttttgttttccgtgtccactttgatgactgtttcatttgtatacaattgaatgttgttttcttcgtaccagtcccaatcgtttaacgtaatatctttaatatctgtatcgccttgaagcacttttgacaaaaggattcggttgtaattgggatgcggttcggcaccgaaaattgtgatctgaaactcgtctttagcaatactcagtatctcttcaatggcccttaccccggccattccattaccaacaagaactagctgtttttttcccatcagatgatccgctccttatcaatgttttttccagcgtagcacagcaaaaaggaatatttaagatacatgttataaaatgtaacaaaatatacgaaaagttctaaaaattttatgaaaaatttaaataggtctgattcggacggcgcataccttaaaaccgggcattttacaggctggatctaaggcttccccgattaaatcattcacattttgagcgtctgcccaatggatgggaacaaaaacagtatcttttctgatttgttctgataatttgctgcggacggtgatgcttccccgcggcgattctatttttaccagtacacggtcctcgatattgtaggtcgctgctgtttgcggatggatttccataaacgattcaaaatgtctcgcggcaagggcggcgctttttcttgtttggacgcctgttaagtagtgagacatgactctgcctgtcgttaaataaagcggataatcggctgtcggcttctcttttggaacaggtggttcgtttggaatcacacttaatgccgctttttgatccggatgagcaaatgattctgtaaacaagcgcccagttccgggatgatcagattccggacacggccaatgaatgccgccttcacgtctgagcctgccgtatgagatgcctgaataatcggcaatcccgcctcggctcgcttctctcaattcattaaaaatatcctccgctgacgtataagaaaagtagcggcccttgccgagagcggatgcgagatcacaaatgatctgccaatcatgctttgcttcgccggggcatggccggcttgcttctcttaatgtcacgcgtccttctacatttgtcatggtgccttcatcttctaagtaagaggaggcaggtaaaatcacatctgcgtatttcgcagtctcagaaataaacaaatcgattgcaacaaagaatgtcagtttccttaaagcctttttcacgagattcgcatttgggctggagacagcaggattggagcacatgaggaacaatcctttgatgtcgccgtcgttgattttttccatcatttcataggctgagacaccttttcgcggcagatcatcctgatggattccccacactttcgcaacatgtgcccggtgttgttcgttttcaatagatcgatagcccggaagctgatcggctttttggccatgctctcttgcaccttgcccgttgccttgtccggtgatcgccccgtaacctgagtaaggcttgccgatttttcctgtgatcagcaccatgtttaagaagcctttcacagccgctgttccatcggtttgctgttcaatcccgcgggctgtaaacagcatgccggacgtttccttggcaaactttacagccgcttttcttatatccaccagggggacactcgtctgttcggcgatgtcattcaggtccaacgagtcagtatgctgcttcagctcttcgaatccatttgttcgtgattgaatgaaatcctcgtttataagctgttcgtcgatgatgattttgacgagaccgttggcaagggcggcgtctgtgccgggtttgattttcaaatgaagatcggcgatttttgttgtcgctgtttcacgcggatcaatggcaatgatgtaagctccgttttctttcgctttttcaaaatatggcataatcgtaggctggcactccgcgatattggtgccggccagaatgatcacacgggtgtggggaatgtctgataagggattcgttaagcctctgtccgcgccgaatgtttggttggctgcggttgctgcggcggacatacaaagcctcccgttgtagtcgatgtattttgtctgtaagcccacccgtgcgaatttccctaacaaatacgcctcttcatttgtaatcgaggcgcttccgtataccgccatagcgtcatggccgtgttctgcttgtatcattgtcacttggtctttaatgtaattcagtgcttcttcccaggaaacaggcataaactcgccgtttttcttcagcagcggccgggtgatgcgggaggagttcagggcatgctggtgggcgttcatgcccttcatgcatagccgaccctgtgttgtaggattatcaatcccgatcgcagtgtactttttgcgcgtgacgatggtttgttccacgagctgcattttgcactgcatgctgcaaaacgggcattgagtgtcatatgttttttctgattggacgtcttgctgtttatcacggaaatatctaagcagtcgttcagtcaaaatgcctcatcctttcttatatgcacccgtctctacagtcgggttttgaatcagtgacagatctgtttggaggctttccagcagctgtgcccttaggtcttcttcgaatagcacttctctgatatgaacgatcccgagacggtctatccactgatgaacaccttctaagtaatgagccgtttcccgataatactggatcagtcctttgatcatgccggcagtgctgtcttcgttctcagtcacgcaaaacaaagctcctgaacgggcatgagttccccggacgccgccgatgtgaatgtcccagccagcttgtctccgaattgcgccgacatcttgcagggcggcatcggtgcagtctgtttcacatgataagctgatagaaatgggagcgggtaagggaagcgtctcaagttgtctttcgatttgggctgccagctgctgaatcgatcgattttgcccgcatgtacatgctttgatgctttgcagcgtgtgtcggtgttcattggtgtaaacgggcattttcagatcttttttcatgttcgggagatccgcaggcttgatcccggaaagcttcagcctttggccgtgagtgatggatacgtcgggaatgctgtatgcctcaatgatgttggcgatggttcttagctgctccgcgtttgtccgcccgccgtacatttgcgggatcaggatgcatgtctcttcagtggctggctcaggctggacaaacccagggtacagcatttccagatagtattgaatcgcaggaacacaagtactgcatccgttttttgttttccagccaagctggttcatcacttctgccggattagtgaatggcctgcgctgaagctcagcgatgatgtcgtcttctgtaaaatcagtacagctgcaaaacgaaggtgtgccggcgggcttcgtatattcgctgttggtcatgtatctcaaaaggtcttcaacgagcggtttgcatcctccgcaggacccagtggctttggtgcagtgcttgacttcctcaacagttgttaagcttttcgtgtacaccgcgtcttcaatcgcgcctttcgtcactgtgttgcattggcaaatcgtttcactggaaggcatggattcaaataaagggccgcttgtctccggttcgatgatctgctttttgacaatggagatgtctcgttgtttaagcaggctgtcgagaagccgctgcttgtcatgggtgtctccgaataaaataacgccggccagtttgtcatctacaaaaagtgcttttttataaacgcctgcttgttcgtcgtagattttgatgctcgtcgtgcgttcatcctcttggatctttcctgctgaccacacatcgattccagctatttttaacgccgaagatggtgctgagccttgatattcctcacatggaacgccgcaaatatgactggcgagaacttttccctgctcataaagcggagccaccaatccgtacaccgttccgttatgctcagcgcattcaccaacggcgtagatattcggttcgcttgtctgcatgaagtcattcacgatgatcccgcggttcactttgattccagcagatacagccaattcaatattcggtttgacgccggccgccatcacaatcaagtctgcttttaatgaagagccatctttaaaatggattcggtctgccttcgtggcgccggaaatggagacggtgtctttctccaaaagaaaggttaggcctttttgttccagctctgtttgcagcagccgcgccgctgtttgatcgagctgtttttgcataatgccggcggagtggtgaatgacgctgacattcataccgagatgctgtaaaccgactgcagcttccagtcctaataagccggctccgattaccgcagccttttgaaagtgctgggccatcttcatcagtgcttggcagtcttctattgtccgaaatccatagacaccttttttgtctgccccggggatagggagaatatgaggggaggagcctgttgccactattaatttgtcatacgacagagtgcgtttccgatctgtgatgacctgctgctgatctgtatcaatttgaataaccttttcgcctgtgtaaagcgtgatcccgttcttgtcgtaccaatccttgctgttcagtgtaatgtcatcgagtgacgcttcaccctgcaatacagaggataagagaatgcgattgtaattgggatgcggctcgcttccgaaaatgacaatctcaaacatgtggcgattcagctttaatacttcttcaatacagcggattccggccatgccgtttcccgctaacaccaatctttgtttcttcatgtattagacctcctttggcgaagctcgtaagttttctcctattaaaaattatgtcacaatgcactgttaacgcattaaacgtgtcacaaaaacttacacatgtcttttccagaaaataatggtcctatatccttgattcagaaaatgtaaaataatgagggtctagaaaggggaatcttatgaagctgtcggaactgaaaactagcggtcatccactcactttgctctgttcctttttatactttgatgtcagttttatgatatgggttatgcttggggcgctgggtgtttatatttctcaggattttggcctgtctccttttgagaaagggcttgtcgtagctgtgccgattttatctggatcagtgtttcgtatcattcttggtattttaacggatagaatcggaccgaaaaaaacggcagtgatcgggatgctggtgacgatgattccgctgctttgggggacattcggcggccgttccctgactgagctgtatgccatcgggattctgcttggcgtggcgggggcaagttttgctgtagcgctgcctatggccagccgctggtatccgcctcatttgcagggacttgcgatggggattgccggagcggggaacagcggcacgttgtttgcaaccctgtttggccctcgtctggcagagcagttcggctggcacattgtcatgggaattgcgctaattccattattgatcgtctttattctttttgtatccatggcaaaggattctcctgcacagccggctccgcagccgctcaaaagctatctgcatgtgttcgggcaaaaggaaacatggtttttctgcctgctgtacagcgtcacatttggcggatttgtcgggctctcaagctttttatctattttctttgttgatcaataccagctatcaaaaattcacgcaggggacttcgttacattatgtgtggcggcggggagctttttccggcctgtcgggggcttgatttcggatcgtgtcggcggtacgaaagttctttctgtattgtttgtcatcgtggcactgtgtatggccggagtcagcagcctgccatctctctcaatggtcattgttctattgtttgtcggaatgatggggctcggaatgggtaacggtgcagtattccagctcgtgccgcagcgttttcgcaaagaaattggcatggtgacgggaatcgtcggtgcggccggaggaatcggagggtttttcctgccgaacatcttaggatctctcaaacagatgacaggcacatatgctatcggttttatcacgttttcctgtatcgcgctgctggcgtttgcacttgtgcttgccgcaggctattactggcggaaaagctggagcgcggaaagcagcccggcggatgtttaggattttgacggacacgcgtttgtgcgtgtcttttttattttctcttgattttcaacagtgaaccgatcaaaataaatagtaattattacgatttgttagtgagaggagttttctgaatgaatcaacatacgctgctcccgaaaaaaacggagcgtcttcaatactttggatcggtcagtccggtcaaaggcgagaaaccagtggaaaaagagaaaatgaaggacctgcaaaatatcaggaaggattatttttttgacattcagcatgtaggtgtcgctaatgtgtcccatccagtcacaatcacttctgccatgatgcctgccgagcaaacaacggctgcgaactttacaatgacttgtaatttgccgagaaatcagaaggggattaacatgagccggttaacagagctgctgcaagtctatcatcaaaatggctggattctctcattttcctctcttcagcaatttacgaaagagcttgcagaaaacatggacacatcatctgccacagttgaagtgaggtttccgtggtttttcgaacggaaaagcccgaagcttgagaaagcgggtttgatgcatgctgatatattcatgtctgtcacctatcacaaagatcagccgtttaaacagcgtgccggcatctcagcaaaagtaacgactctgtgcccttgctccaaggaaatcagcgaatacagtgcccataatcagaggggaacggtcagcatttgggcggatattcacccggccgcatcgctgccaagcgatgttaaagctgatttgcttcacgccgcagaatcaaatgcttctgcgagactgcatccggtattgaagcggcctgatgaaaaagccgtgacagaaacggcctatgaaaacccgagatttgttgaggatctcgtccggctgattgctgctgatttgtttgagcttgaatgggtgtcggcctttgagattgaatgccgcaatgaagaatcgatccatctccacgatgcctgcgcgaagctgcgtttttcgaaggaagtggataaaatatgaaactctcattattcattattgcagttcttatgccagtcagcctgctgtcagcctgctccgatcatgcagaagaacacgcaagtatcaatacaaagaaaacggtcgaaaacataacggacgttcgaaaaacagcaaaaacaagcattgattggacaaagccttcgggcggagaatacccggatattaaacagaagcatgtctggattgatgtgaatgtgaaggagcagaaggcttacatcaaggaaggaagcaacaccatctatacaatgatgatctcttctggtcttgatcaaacaaaagatgatgctacgccaaagggcaccttttatgtagagcctgaacggggagaatggtttttctccgaaggataccaggaaggcgcagaatactgggtatcatggaaaaatcacggtgaatttttatttcatagtgtgccaatgactaaggatcaaaaagtcatcaaaacggaagcagaaaaactaggaacgaaagcatctcacggatgtatcaggctgaccattccagatgcgaaatgggtatatgaaaatatccctgaacatacaaaagtggtgatcagctgaattgaaaaccgttgacaaaaaggaaaaaagaccatacaatttaaatcgtaacaattgcgttttatgataaatggcttatcattggctgtatctgtgaaaagcggaaaggctaaggatcttgctgtcattgatccccatgaagcgtctcttgaaaactggaaacgaaacccaagctactttctgatgagatatttgcgctttccatcggttcagcaacgcaagtggagcgattgctttatgcaagctgcggttttccgaatgtcggcaaggatttgcgatggggaaaaggattaaacgcggttgaagcctttactgatttagaaaccgggtggcagcgagaaatgagcgcgaaaagctgctctacactattgtacatatggcgaagtatacaatttaaatcgtaatcattctattttaatggaggcattattatgaaaaaaattccggttaccgtactgagcggttatctaggtgcgggaaaaacaacattgctgaacagcattctgcaaaatcgcgaaggcttgaaaatagcggttatcgtaaacgatatgagcgaggtgaacattgacgcgggcttggttaagcaggaagggggcctttccagaacagatgaaaagcttgtggaaatgtcaaacggctgcatttgctgcacgcttcgcgaagacttattaattgaagttgagaagctggcaaaagacggacggtttgattatatcgtcatcgaatcgacaggaatcagcgaaccgatcccggtggcccagactttctcttatatcgatgaagagatgggaatcgatcttacaaaattctgtcagctggatacgatggtgacagtggttgatgccaaccgtttttggcatgattatcagtcaggcgaaagccttctggaccgcaaagaggcattgggggaagaggatgaaagagaaatcgccgacctcttgatcgatcaaattgagttttgcgatgtactgatcttaaataaatgtgatttggtcagcgagcaagagctcgaacagcttgaaaacgttcttcgtaaactgcagccaagagccaggttcattcgttccgtcaaaggaaatgtaaaaccgcaggagattttgcatacagggttatttaacttcgaggaagcgagcggatcggccggctggattcaagagctgacggcaggccatgcggaacacaccccggaaacagaagaatacggtatctcttcatttgtatataagagacgtttgccgtttcattctacacgattttaccgttggttggatcaaatgccaaagaacgtggtacgtgccaaaggaatcgtctggtgcgcatctcataacaaccttgctttgctgatgtcgcaagcaggtccgtcggttacgattaagcctgtatcttattgggtggcggcgctgccgaagcttgagcaggagcaagtcaaacagcaggagccggaaatcctggaggagtgggacccggagttcggcgaccgcctaacgcagctagtttttatcggaactgacctggatgaagaaacgatcacgaaagagcttgatcaatgcctgctgactgaatatgaatttgattccgactggtcgctgtttgaggacccgtttaaatggaagctgaatcaatagaaaaaaagccgtcccctggggagcggctttttttaatgaaacgtttgtttaaacataatgagcgtattttttctcaaggatattctgaaagaccgcggcaatggagcagatggcccaataaatgagagcggtcagaatatacatggtcatataatcaaactctctgcccccgatgattttcgcatgctggagcaattccggcactgtaatcatcgcagcgagagatgatgccttgattaagtcgagcaatacattggcaagcggaggcagcgcaatacgtatcgattgcggcaaaatgatgcccctcatcgtctgccaataggaaagacccagcgaggatgcggcttcccactgtcctttttcgacggatgaaatggctgaacggttaatttccgcaatgtaggcggcgctgtttaggctaaagccgattaaagcagccgtgacagcggaaaattcaatgccgatataaggaaacccgaaataaaggataaacaaaatcaccaaaatcggaacgccccgcataaatgagatatagagcttcgccggccatcttaacaaagcaagcttagacattctggcgagtgatatgaacaggccgatcacagttcccgcaaacatgcttacaaaagagataagcagtgtatacccaatgccttttatgacataagggaacgattcaatagccagcttcgtgttgaaaatatattcccattgaatgctattgatcatggcgtccgattacaaatcaacgtcctgaacgtcggcatcaattttttttgatacatctgctttattgaagaattgtttcgacagtttagtcaaagagccatccttgctcatctctttcaatgcttcgttcatctttttctgaagtgccgcattgctttttttcatgacaagggcctgtttgttcggcatgtacttgatgtcaggatgaattgttatgttgagatccgggaatgccgcgagcgcaagtgtctgcaggtaatagtcgtttaaaatgacgtcagtgcgtccgttggcaacatcttttaaatattgctcattcgtcgcattatcataaatcacttctttggcgccgtattttctcgcgacctccatgtagacggttgtagccgcgccagccgctttcttcccttttaaatccttgagcgttttaatccctgataaattgtcttttcggacaattgccgtgccgtatgaatatttataaggagtagaaaatgcgaacttcttctcgcggtccttcgtcacatcgatgtcattcgcggctgcgtcaacctgtccgctgtttaccgctgtcagcatcccgtcaatgcccatctccttgaactcaaccttcaatcccaggcgttttgccgcttcacgaacgacttcaacctcgtagcccgtcagcttatcagagccagagtcagtatcgtgataagaagtgggataaagcgtgcctgatgtagcgactacgattttccctttatccttaatctgctcccagcctgtatccttggaatcggcttcatttttgccggaacaggctgccaatataagaaagaaagccattgtgaaactgaatataacggctttggaatgcatgaatgatttcacctatagttcccccaatctgttaatcaactaaaaagatagcattgaacataaggggttgcaatatgttgatcgcgttttcaaaaagttcgaattgtgtatacaaaaggcatgggtgggtgattaaaagcggctatgaagggaattggtgatgaacaaaggagttgtccaaggatgaatgcccgacgtaccaaggaaacacatgtggacgtgaaggatgcagtagatccgttattcctctatgccaataccgtaagaaatggtcagaagcatgaaatcgatcttcagaataaatttaagtcttgctgatgcccctaagacatatgatatatccgatgagaaagaaaatggaaacatttaaaccataatggggagtcaaatgaatatttacaaaccagccggattttggatcagacttggagctgcattgttagactatattatagtctccgtgccgcttttgctgatctattggctgattacaggaaaagacccaaacgacagcatgttcatcagtttggttgttctgctgtattctattttgctgccggtgttttggcgcggttatcttatcggaaaaaggatctgcggaatcagaatcgtaaaaaaagacggatcacaggtcagtctgttaacaatgtttttacgggttattgtagccggcctggtttacgttataaccttcggactcggcttgatcgccagcctgattctgattgccgtacgagaagacaaacggaccctgcatgatttaatcgcgggaacatcacttatgcgaccaggtgaagaagaacttaatgctgacgaagagattagaaagagcgaataatggttcgctctttttatttttatgcataaaaaatacaaggcagcaaaacatatgaaaaataggattggaggaataaactggatgaaacgaataaccatcaacattatcacaatgttcattgcagcggctgtcatttctctgaccggtacagctgaggccgctgaaaaacagcagcagtctcccgcaaatgttacactgacagatcagcaaaagaaagagattgaacaactggaagcagagattcttaaaaagcgcaaagacgtgatctcaaagtatgtacaatacggtatcctgcctaaagaaagaggagaacacatcaaaaatcacttggacaaacactttgaaatgatgaaacaaaacggctttgttccaaagcaccatcctcatccgcataaatttgaaaaaagacattaaaatggaaagcatccaatgggaattgggtgcttttttattgttaaaagttactgaatgaattttccggaaaaatatatcgcttttgttgattatatcttataataagatataaatggggtgtataatgatggaaatggatttaatctctaaacttaatcagcagtggacagatatttattatttattacattatcaacataaagataatatttctcaccaggcaatacggattatgcagcatattgaaaagcaaggtgaggcaacaataggagctttggctgaatacttgtctgtctctcacaatacggcgtcagagcatactaaacgtttgattcaaaggggatttatagctaaacggcgaagtcaacaggatgaacgaaaagttttagttttcttaacacaagaaggaagatctgttcttgaacagcatacacagctagataaagagaaattaaaagaaataattgaacgaatgagcacattagaaaaagaattacttgaacaggcatttgaacttttaagtagggaagctaaacaatggcagttttaagtaaagtgatcatctctgcgttgattatcggttttgttactgaaatatcaaaaagacatccgacctatggcggcatcattgctgctttgcccttggtcagtttattaagccttttttggatgcaaatacaaggtgaaaaaatagctcaattaagtcaatttgcatctggtgtgcttacaggaatcccagctacagtttgtttactagctattttggcttttttgctgaaaattcatgtgccgttttggtttgcattatgtgttggaatactaggatgggctatgtttttatggatgcagaagatctttctcaatatattatttaactgagtatagaaaggagatgctatgtttttaaaaaaggttactcttcttcgagataagattttggactttgacagatttccttttactatcccggctataagtcaattaaatgacatcttatttactagccaagtgactttttttgtgggggaaaatggatctggaaaatctactttgcttgaagcgatagcagataagtgtgaattcaatacagcgggcggaagccgaaataatgtctatgaattacgggagtcagattcccatttaggagattacatacgtttatcttggcttccaaaggtaacaaatggcttcttcttaagggctgaatcgttttatcatctttctcttcatctggatgagatggaactagatgctcctcagccataccgttcctatggagggagaccgctacacaatcaatcacatggagagtcctttatgtctctattccgtcatcgttttaaagagaaagcgatttaccttttagatgagccagaagcagcactttctccagctagacaattagcttttttgagagttatacatgatttggtgaagggcggaaatgtacagattatcattgcgactcactccccaatcctactgggctatcccaatgctaatattttaagctttgatggtggaagaatacatcatattgaatatgagaatacagagcatgttcaattaacacgatattttcttggacaaagagaaaaaatattagctgagctgttccgcgactaacatcgagttgatctgaaacgcgtttcatagcctatgataggtttatcaaataattcaggagtgataaacactatgatccaccagcatccagaatcttttccgaaacattttttgtggggctctgcttctgcagcgtaccagattgaaggcgcttggaatgaagatggcaaaggcccttctgtttgggatgtgtttacgaaaataccgggcaaaacgtttaaaggaaccaatggcgagattgcggttgaccattatcaccgatttaaagaagatgtcgctctgatggctgagatggggttaaaagcatatcgattttccgtcagctggccacgggtttttccaaaaggaaaaggagagatcaatgaagcaggtctagcgttttacgatagtctgattgatgaattgctttctcatcacatcgagccggttctgactttatatcactgggatttgcctcaagcgcttatggacgaatacggcgggtttgaatccagaaacatcatagaggattttaatcactactgtattactctttataaacgttttgaagacagggtgaaatattgggttacgttaaacgaacagaactacaattttaatcacggatttattacagccatgcatccgcctggagtgaaagacagaaaacgattttacgaagcaaaccatattgcgtttctggctaatgcaaaagccatcgaatcatttagagaatatgtgcctgaaggcaaaataggtcctagctttgcttattctccggcttaccctttatcaagccatccagaggatatactggcatttgaaaacgccgaagaatttatgaacaattggtggcttgacatgtattgctggggaacctacccgcaaattccattccgctacttggaaaaacagggatgggcgccgacaatcgaagcaggagatatggagctgcttgccaaagggaagcctgattttgtaggtgtcaattattatcagacgatcacctatgaacgaaatccgcttgatggtgtgtctgaagggaaaatgaatacgacaggccaaaaaggaaccaatcaggagacggggatacccggggtgttcaaaacgaaaaaaaatccgcatctgacaacgagcaactgggattggacaattgacccaattgggctgcgtatcggtcttcgccgaattacaagccgctatcagcttccagtgtttataacagagaacggtttgggtgaatttgataaagttgaggacggcactgtacaggatgattatcgaattgattatttgcgttcgcatcttgagcaatgcagacaagccatcagtgacggtgtcgatttaatcggctattgcagctggtcgtttactgatctgttaagctggctgaacggctaccaaaaaagatacggatttgtatatgtcaatcgtgatgaagaaagcacatacgatttaaaacgcttgaagaaaaaaagcttttattggtatcaagatgtcatcaagacgaacggagaaagtttataaagagtccctgagagttattctctcaggggtttttcattacacagaaacagcatcaataatataagtgtcggcgtgcaaatctgacatttcagccggcacagtccagcatgtcaattgatagtctcctttaggcagatcaaaggacagtcttttagacatgatgctttcaatatgaattccgttttctgtgacatgaaaaggaacagtcacttttttttcgtaggagcttactgtttctgaactgttcaggcgcaaaagaataaaggcctttgtatttcgctgtgcctcaaaggaaatggctccgtctgccgcagcatatcctttttcaatcgcttcgtcagtccaatccattacaggaggtgtagaatccttttgaaatacagtaaattgatgatatgaaatcgaaagttcttgcggcttccatgatttgatcaatgtgctgttcctcctctatgtactgtttactgaattgtgaataaaacctttgtgccgtctgggtaatcggtaagctgatgcccgacccaagagcctgctccgcggttgtcagcgggagaaatgtattctacagaagctccctcaccgccttctttgcacatggccattggccattcatctctgtcatacccctttttggaaggtacgtcctttaatgattgctcgcggcgttcctcagctccgtctctgtcaatagtgcacacctctgagtgcccctcatttatcgcatccttaatatgcttggcagtttcgggataacggtcagaaggaaaggtgattgtttcatcatattctttcgtttgagacgttttttgatcagctgagaaaaagtctccttttatcaggccgacagctgcagctgctatgatgacgatgacgagaagtatcgtttttatgatgtccgtcgtgatgttcacctcccgcttttaaaactgacacaagagtaatccagaaagcatttggtgtaaaggtttaaattttatgttttacgatcagtttattgcagaaatcgtaattttagcagatcgaaatatttgttttcagcaaaatacgattgccaatttacaataatgatagtaagtcatcagccgttttcggcttgattaatcattttaaattggcttatgataccggtaagctcctcagctaattgagaaagtgtttcagaagctgcggtaatctcctccattgcagcaaattgctcctctgttaatgcagccgcttgccgggtatttttagtagattctttaatgtcggccgtattggctgcaaaggaatcatttatttgatgtgcactggctgaaatgtttgttacagatgctgataaatcactaatctcggcgctgatttcacctgttgcagctgcaatttccttaaatgcatctctggtgcgctggatcatggtgactccttctgcagcttctgttttcacatgctcaacagatcttgcagaccggttcatatccttttgtatttctatgatcagttttgaaatctgccccgcagactgttgagactcttctgctaatttccgtacttcatcagcaacaacagcaaagccttttccttgttcaccggctctggcagcttcaatcgctgcattcagcgcaagcaggtttgtctgatcagcaatttgggtgatgaccgataaaatttgctcaatttgtttagagcggccgtctaactggtgtatgatttctccgcttttctgaattgactggtgaatcgcatccatttgcgcctgtacatttgcaatttccttttgtccaatgtctgcttttgattgagcgagctgccctttgtcagcgatagcggcagtatttgcagaaatatcccggatgtctgctgaagcttgttttaatgagctttcactattttcaattcgggtgatctgatcttgggctccatttgcaatctgctgtacagcttctgtgattttttctgaagcttgatttgtttcctctgctccggctgagagctgctgagaggctgacgcaagctgaagggctgattgttgtacggtttgtatggtatcgttcagcttcattctcatcttattataatagacgcttagttctgaaagctcgtcaccggttttgtctgacacctctattgtcatatctccgtttccggcactttcaaaggcgctttttaaagcgttcagccgcttgttgatttttctggtgaaaaccaaaacaaggatgactgatactataatgacgataacaagaacgatagcgaattgagtgaaaagtgattgtgtaagtgatgctaaaatactttgattagctccggtatacagcatgccgatgatgttgccattttgatcttttaacggcatgtatgcagtctgataagaagaacctgctacatctgcttgtccgtaaaaacgctttcctttctttaaaacagcggcaataacttcagaagaagcctgggtgccgacagctctttcgccattcttcatgacattggttgcaacacgagtatcgccttggaaaatggtaatggtatcacctgtcttttcaccaagcagatcaacaatatcttcatttccattgatttgtgtttgccctttatagagcttattgtttttcacctgccagtcgcctgacatgacatcatcaatataagtgctgcttaaagcgagatcacctttcgctttttcagttgccatttgtttcatgttttctgtaatttccttaagcatcacagtgccaactgatgccgaaaacaaaagaatcaccacgaaaacgaggcaaagaattttagttcctagcttcatcttaaatcgttttatcaacataattcctccctttacgatttgcaggtcatattacttatcgggtttttgggtttaaagttttattttagaaaaaataaaaccgacctgatcttcaggccggttgtgtgatgctattcaaggtttgcgtggtgagtgaacatagtttcagaatcgagtccttttttctccatgagttttaaaatcactgcatcatagaatagcagcaaagtttgttcaaataatgatcccattggctgaatggttttatagcttccgtttgactggtctttaggagaaccaggcattctgatgatgaggtccgcttgttttccgatgcttgattccggattgatggttaaagcggcaacaattccgtgtaagctttttgcttttgctgcggtatgaatcaagctttttgtctcgcctgatcctgagccgataataactagatctcctttggcgagcggcggagtgagaatctcacctacaatatgggcgttgaagcccatgtgcatcagtctcatcgcgaaggattttgccatcaggccagaccgccccgcacccgcggtgaaaatttggtgggatgaaagaatgtgatcggcaagctggtcagcttcttcattagaaatataagctactgaattgtgtaactcattgagaatttccgctacgtattcagtcgttttcataggagttatccttggacaatcagctgcttcatttttgaagctgtttccgccttatcagctgcgcttgtaattccgcccccaacaatgacaaggtcagggttttgcttgatcacttctggcagtgtatcaagtttgatgccgcccgcgattgcggtttttgcgttttttacggtatttttgattgtcgttaattcttcgaaagagtttttgccctctgcttgaagatcatagccagtgtggacgcagatgtagtcaacgcctagtgcgtcaatttctttcgcacgggattcgatatctttcacgttaatcatgtccactaagattttcttcttttgttttttggcttcttctactgcgcctttaatcgttgcatcgtctgtagcccctaaaacggtgatgatgtcagcgcctgcttccgacgctttcataatttcgtagcctccggcatccatgattttcaggtctgcaagaaccttcaattgaggaaatgcttcttttatttctttaacggctcttaggccttcattgatgacgaccggtgttccgatttcaactacgtcgatgtattgttctacctctttgacgagctcaatggcttccgggatgttgacgaggtctaatgcaagctgtaattccattgttgattcactccctttttcgaattatttttcattctataggttctcttatttgatgagaagtaggcactttgaagtcaacaagttacttggaggatactgtgaggagagacaatcagatttctttcgcttgattttatgagtgagtataatgaaaaaagagtctgcaaaaaagtaagtaagtgatgatacgtatctaacatacaaaaagattactaaggggggattctattgagccggatggacgacaaaaggtttaattgtgagaaggaattaacgcttgcagtgattggcggtaaatggaagatgctcattttatggcatttaggaaaagaaggcacaaaacggttcaatgaattaaaaacattgattcctgatattacgcagaagatcctcgtgaatcagctgagagaacttgagcaggatatgattgttcacagggaagtgtatccggttgtcccgccgaaggttgagtattctctgaccccgcatggagaaagcctcatgcctattcttgaagccatgtatgagtgggggaaaggctatatggaattgattgatatcgacaaaaatgtcatgaaagaatcgttgtaagacgctcttcgcaagggtgtcttttttttgcctttttttcggtttttgcgcggtacacatagtcatgtaaagattgtaaattgcattcagcaataaaaaaaaattgaacgcagcagtttggtttaaaaatttttatttttctgtaaataatgtttagtggaaatgattgcggcatcccgcaaaaatatccctgtaaataaactggaatctttcggcatcccgcatgaaacttttcacccatttttcggtgataaaaacatttttttcatttaaagtgaacggtagtaagataaaaaatattgaaaacaatgaataaatagccaaaattgtttcctgttaggataggggttcttgcggtctttatccgcttatgttaaacgccgcaatactgactgacggctgcccgttttaatagcggcaatctgttttttgtttggaagcactgctttttaagtgtagtactttgggctatttcggttgttagttcataagaattaaaagctggtatggataaaaaagagaaaatgctctgcacaagttcactgtttatgaagactaggggaggtatgaaaatatggaaataactttttatcctttaacggatgcacaaaaacgaatttggtatacagaaaaattctatcctcacacgagcatttcaaaccttgcggggattggtaagctggtttcagctgatgcgattgattatgtgcttgttgagcaggcgattcaagagtttattcgcagaaatgacgccatgcgccttcggttgcggctagatgaaaacggggagcctgtacaatatattagcgagtatcggcctgttgatataaaacatactgacactactgaagatccgaatgcgatagagtttatttcacaatggagccgggaggaaacgaaaaaacctttgccgttgtacgattgtgatttgttccgtttttccttgttcaccataaaggaaaatgaagtatggttttacgcaaatgttcatcacgtgatttctgatggtatctccatgaatattctcgggaatgcgatcatgcacatttatttagaattagccagcggctcagaggcaaaagaaggaatctcgcattcatttatcgatcatgttttatctgaacaggactatgctcaatcgaagcgatttgaaaaggacaaggcgttttggaacaagcaatttgaatcggtgcctgaacttgtttccctgaaacggaatgcttccgcaggaggaagtttagatgctgagaggttctctaaagatgtgcctgaagcgcttcatcagcagattctgtcgttttgtgaggcgaataaagtcagtgttctttcggtatttcaatcgttgctcgccgcctacttgtacagggtcagcggccagaatgatgttgtgacgggaacctttatgggcaaccggacaaatgcgaaagagaagcagatgcttggcatgtttgtttctacggttccgcttcggacaaacattgacggcgggcaggcgtttttagaatttgtcaaagaccggatgaaggatctcatgaagacactccgccaccaaaagtacccgtataatctcctgatcaacgatttgcgtgaaacaaagagctctctgaccaagctgtttactgtttctcttgaatatcaagtgatgcagtggcagaaagaagaggatcttgcctttttgactgagccgattttcagcggcagcggattaaatgatgtctcaattcatgtaaaggatcgatgggatactgggaaactcaccatagattttgattaccgcactgatttattttctcgtgaagaaatcaacatgatttgtgagcgcatgattaccatgctggagaacgcgttaacgcatccagagcataccattgatgaattaacgatgatttctgatgcggagaaagagaagctgcttgcgagggccggcggtaaatctgtgagctaccgtaaggacatgacgatcccggaactgttccaagaaaaggctgagcagctttcagatcatccagcggttgtattcgaagatcgtacattgtcctatcgaacgttacatgaacaatccgcacgcatcgccaatgtgctgaaacagaaaggggttggcccggacagtcctgtcgcggttttgattgaacgttctgaacggatgattacagctatcatgggaattttaaaagccggcggagcctatgtgccgattgatccgggttttcctgcagagcggattcaatatattttggaggactgcggggcggacttcatcctgactgaatcgaaggttgcagcgcctgaagccgatgctgagctgattgacttagatcaggcaattgcggaaggtgcagacgatatgacggaggctgatgtaaacgcgcggaatcttgcctacattatttacacatcgggaacaaccggacgtccgaaaggcgttatgatcgagcatcgccaggttcatcatttggttgaatctctgcagcagacgatttaccaaagcggcagccaaaccctgcggatggcattgcttgcgccgttccactttgatgcgtcagtgaagcagatcttcgcgtcgcttcttttgggacaaaccctttatatcgtaccgaagaaaacagtgacgaacgggaccgcccttgctacatattatcggagaaacagcattgaggcgacggatggaacaccggctcatttgcaaatgctggcagcagcgggcgattttgaaggcctaaaactgaagcacatgctgatcggaggagaaggcctgtcatctgttgttgcggacaagctgctgaagctgtttaaagaagccggcacagcgccgcgtttgactaatgtgtacgggccgactgaaacgtgcgttgacgcgtctgttcatccggttatccctgagaatgcagttaaatcagcgtatgtgccgatcgggaaagcgctggggaataaccgcttatatattttggatcaaaaaggccggctgcagcctgaaggcgtggcgggtgagctttatatcgcgggagacggtgtgggccgaggctatttgcatttgcctgaattaacggaagagaagtttttacaagatccattcgtgccgggcgatcgcatgtaccggaccggggacgtggtgcgctggcttccagatggaacaatcgaatatttaggcagagaggatgaccaggtcaaagtccgcggataccggattgagcttggggaaattgaagccgtgattcagcaggcgccagacgttgcaaaagccgttgttttggcacgccctgacgaacagggaaatcttgaggtttgcgcatatgttgtgcagaagcctggaagcgaatttgcgccagccggcttgagggagcatgcggccagacagcttcctgactatatggtgccggcttactttacagaagtgacagaaattccgcttacgccaagcggcaaagtcgaccgccgcaagctgtttgcactagaggtgaaggctgtcagcggcactgcctatacagcgccgcgaaatgagactgaaaaagcaatcgcagccatttggcaggacgtgctgaacgttgagaaggcggggatttttgacaatttctttgaaacgggcgggcattcattgaaggccatgacccttttaacaaagattcataaggaaacaggcatcgagattccgcttcaatttttgtttgagcatccgacgattgcggctcttgcagaggaagctgatcacagagaaagccgggcattttcggtgattgaacctgctgaaaaacaggagcattatccgctttctctggcacagcagcgaacatatatcgtcagccagttcgaggatgcgggagtcggctacaacatgcctgcggcagcaattctggaagggcctttagatattcaaaaactggagcgcgcatttcaggggttaatccgacgccacgagtcattgagaacatcatttgttcttgaaaacagcacgccgagacagaacattcacgatagcgttgatttcaacatcgaaatgattgaaagaggcggccgctcagatgaggcaattatggcttcattcgttcggacatttgatttggcgaaagctccgctgttcagaatcggtttgctggggcttgaagagaaccgtcatatactgctgtttgatatgcaccatttgatttctgacggtgtatccattggcattatgctggaggagttagcacgcatttataaaggcgaacagcttcctgagcttcgtctccagtataaggactacgctgtatggcaaagcagacaggctgctgaagggtacaagaaggaccaggcttattggaaggaagtctttgcaggcgagctcccggtgcttcagcttctgtccgattacccaagaccgcctgttcaaagctttgaaggggatcgggtgtcaatcaagctggatgcgggggtaaaggatcgcctcaatcgtttggctgaacaaaacggcgccactttatatatggtgatgctgtccgcttactatacgcttttgtcaaagtatacggggcaggatgacatcattgtcgggacaccgtcagcgggcagaaatcactccgatacagagggcattatcgggatgtttgtcaatacgcttgcgattcgcagtgaggtgaagcaagatgagacgtttacccaattgatctcgcgtgtccgcaaacgggtgctgaatgccttttctcatcaggactatccgtttgagtggcttgttgaagatttgaacatcccgcgtgatgttagcaggcatccgctgtttgacacgatgttcagccttcaaaacgcgacagcaggcattccggctgtcggcgatctgtccttgtctgttcatgagaccaatttcaagattgccaaatttgatttgaccgtgcaggcgagagaaaccgatgaaggcattgagcttgatttggattacagcacaaagctgtttaaacaaagcacggcaaacaggctgcttacgcattttgcgcgtttgcttgaagatgctgcggctgatccagagaagccgatttctgagtataagcttctttctgaagaggaggccgcttcgcaaattcagcagtttaacccgggcagaacaccttatccgaaagataaaacaattgttcagctgtttgaggagcaagcggcgaatacgccagaccatactgcgcttcaatatgaaggcgaatcactcacttatcgtgaactgaatgaacgggccaatcgtttagcccgcggcattctttctcttggagctggcgaaggcagaactgcggctgtcttatgcgagcggtcaatggatatgattgtgtcgatcttggcagtattaaaatcaggttcggcttatgttccgattgatccggaacatccgagtcagcggatgcagcatttcttccgtgacagcggagcaaaggtgcttctcactcagagaaaattaaaggctttagcggaagaagcggaatttaagggcgttatcgtgctagccgatgaggaagagagctatcatgccgatgcgcgcaatctcgcactgcctcttgattctgaagcaatggccaacctgacgtatacctctggaacgactggaacacctaaggggaatatcgtgacacatgccaatattctccgcacggtgaaggaaacgaattatctcagcattacagaacaggatacgattctcggtctttccaattacgtgtttgacgcgtttatgttcgatatgttcggatctttgttaaacggagccaagctggtgctgataccgaaggaaaccgttttggacatggctcgtctgtcccgcgtcattgaacgggagaatatcagcattctcatgattacaaccgctttgttccacttgcttgtggacttgaatccggcgtgcttgtcaacgcttcgcaagattatgtttggcggggaacgggcttcggttgagcatgtcagaaaagctttgcaaacggttggaaagggcaagctccttcacatgtatggaccgtctgaaagcacggttttcgcgacgtatcatccggttgatgaattggaggagcacacgctgtctgttccgattggaaaaccggtcagcaatacggaagtatacattcttgacagtacgggacacgtgcagcctgccgggattgccggagagctttgcgtcagtggcgaaggactcgtgaaaggctattacaaccgtccagaactgactgaggagaaatttgttccccatccgtttacatccggcgaacgcatgtataaaacgggagaccttgctagatggctgccgaatggcgacatcgaatttatcgggcgaatcgaccatcaggtgaagattcgcggacagcgcatcgaacttggagaaatcgaacatcagctgcaaacccatgatcgtgttcaggaaagtgttgtgcttgccgttgatcaaggagcgggagataaactgttgtgtgcttattatgtcggagagggagacatctcatcacaagagatgagagagcatgctgcgaaggacttgccggcatatatggttcctgcggtgtttatccaaatggacgagctgccgctgacagggaacggaaaaattgaccggagagcgctgccgattcctgatgccaacgtttcaagaggtgtttcatatgttgcgccacgcaatggaacggaacaaaaagtcgcagacatttgggcacatgtgcttcaggcagaacaagtcggcgtttatgaccacttctttgacattggcggacattcattagcaggcatgaagatgcttgccttggttcatcaggaactgggcgttgagctgtcactcaaggatctcttccagtcaccgacggttgagggcttggcacaggtgattgcctctgctgaaaaagggacagccgcaagtatcagcccggcagagaaacaagatacgtatcctgtttcttcaccgcaaaaacggatgtacgtgcttcagcagcttgaggatgcgcaaacgagctataacatgccggcggttctgcgcctgacaggtgagcttgatgttgaaaggcttaacagcgtcatgcagcagttaatgcagcgtcatgaagccttgagaaccacgtttgaaataaaagatggagaaacggtgcagcggatctgggaagaggctgagtgtgagatagcctatttcgaagccccggaagaagagacagagcggatcgtttctgagtttattaagcctttcaaaatcgaccaacttccactgttcagaatagggcttatcaagcattcagacactgagcatgtgctgctgttcgatatgcatcatattatttctgatggtgcatctgtcggtgtgctgattgaggagctttcaaagctgtacgacggagaaacccttgagccgctccgtattcaatataaggattatgctgtgtggcagcagcagttcattcagtctgagctttacaagaagcaagaagagcattggctgaaggagctggacggagagctgccggtgctgacgcttccgaccgattacagtcggcctgccgttcaaacatttgagggagaccgcattgcattttcattagaagcaggcaaagctgatgctctgcgcaggcttgcaaaagaaacggattccacgctttacatggtgcttctggcttcatacagtgcatttttatcaaaacttagcgggcaagacgatatcatcgtcggttcacctgtggccggacgatctcaagcggacgtcagccgcgtcatcggaatgttcgtcaatacattggcgctgcgcacgtatccgaagggtgaaaagacgtttgctgactatcttaacgaagtgaaagaaacggcactcagcgcttttgatgcgcaggattacccacttgaggatttgatcggaaatgttcaggttcagcgtgacacaagcagaaatccgttattcgatgcagttttttcaatgcaaaatgcgaatataaaggatttaacaatgaaagggattcagcttgagccgcatccgtttgaacggaaaacagccaagtttgacctcacgctgacggctgacgaaaccgacggagagcttacattcgtactcgaatacaatacagctctgtttaagcaggaaacgattgaacgatggaagcaatattggatggagcttttagatgatgttactgggaacccgaaccagctgctttccagcctgtcactggtcaccgagacagaaaagcaagcgcttcttgaggcatggaagggcaaagcgctgcctgtgccgacagacaaaacggttcatcagctattcgaagagactgtccagcgccacaaagaccgcccggctgtcacatacaacggccagtcttggacgtacggcgagctgaatgcgaaggcgaaccgtctcgcgcggattctgatggactgcggcattagcccggatgaccgcgtcggcattctcacgaagccgtcgcttgaaatgtccgccgcggtgctcggcgtcttgaaagccggagcggcgtttgtgccgattgatcctgactacccggatcagcggattgagtatattttacaggacagcggcgcgaagcttctcttgaaacaggaagggatttcagtgccggacagctttacgggagatgtcattcttctcgatggaagccgcacgattctaagcctgccgcttgatgaaaacgacgagggaaatccagaaaccgctgtaaccgcggagaacttggcgtacatgatttacacgtctggaacgaccggacagccgaagggtgtcatggtcgagcaccatgcgcttgtgaacctgtgcttctggcaccacgacgcgttcagcatgacagcggaggaccgcagtgcgaagtacgcgggctttgggttcgacgcttccatttgggagatgttcccgacctggacgatcggtgccgagcttcacgtcattgatgaagcgatccgcctcgatatcgtccgcctgaacgattattttgaaacgaacggcgtaacgatcacgttcctgccgacacagcttgcggaacagttcatggagcttgagaacacatcacttcgcgtattgctcattggaggagacaagctgaagcgcgcagtgaaaaagccgtacacactcgtcaacaactacgggccgacagagaatacggtcgttgccacaagcgcagaaatccatccggaggaaggctcgctttccatcggaagggccattgccaatacgagagtatacattctcggcgagggcaatcaggtgcagccggaaggcgtagccggagagctttgcgtggcggggcgcggactggcacgcggctatctgaatcgagaagacgaaaccgcgaagcggtttgtcgctgatccgtttgtgcctggtgagcgcatgtaccgcaccggcgatttggtgaaatggacgggcggcggcatcgaatacatcggccggatcgaccagcaggtcaaggtccgcggctaccggatcgagctctcagaaattgaagtccagctcgcacagctttctgaggtgcaggatgcggcggtgacagctgtcaaagataaaggaggcaacacagcgatcgcggcgtatgtcacaccggaaacagctgacatagaagcactgaaatcagcactaaaggaaaccctgccggattacatgatcccggcgttctgggtgacgctggacgagcttccggttacggcaaacggcaaagtggaccgtaaagccttgcctgagccggacatcgaagcgggaagcggagaatacaaagcgcctacgaccgacatggaagagctgcttgccggcatctggcaggacgtgcttggaatgtctgaagtcggtgtcaccgacaatttcttctcgcttggcggagattccatcaaaggaattcaaatggcgagccgcttgaaccagcacggctggaagctggaaatgaaagatctcttccagcacccgacgatcgaagagctcacccagtacgtagagcgtgccgaaggcaaacaggcagaccaaggcccggtagagggcgaagtcatcctgacgccgatccagcgctggttctttgaaaagaacttcacgaacaagcaccactggaaccaatcggtgatgcttcacgccgcgaagggctttgaccctgaacgggtggagaaaacattgcaggcgctgatcgagcatcatgacgcgctccgtatggtctatcgtgagggactggaagacgtcattcaatacaacagaggtcttgaagctgcttccgctcaattggaggtcatccagattgagggccaagctgcagattacgaagaccgtatagagagagaagcggagcgtttgcaaagcagcatcgacttgcaggaaggcggcttgttaaaagcaggattgttccaagcggaagacggagaccacttgcttcttgccattcaccacttagtggttgacggcgtgtcgtggcggattttactggaggatttcgccgcggtatatacacagcttgagcaaggcaatgaaccggttctcccgcagaaaacacattcatttgcagagtatgcagagagattgcaagacttcgcgaactccaaagcctttttgaaagaaaaagagtattggagacagctcgaagaacaagctgtcgcggcaaagcttccgaaagaccgcgaatctggtgatcagcgaatgaaacatacaaagacaattgaattctcgctgactgctgaagagacagaacagctcaccacaaaggtgcatgaggcatatcacacagaaatgaatgatattttgctgacggcattcggattggcaatgaaggagtggacgggtcaagatcgagtaagtgttcatttagaggggcatggacgtgaagaaatcatagaagacctgaccatttctcgcacagtcggctggtttacaagtatgtacccaatggtgctcgatatgaagcatgcggatgatctgggctaccagctgaagcaaatgaaagaagatatcagacatgtgccgaataagggagtcggatacggcattctgcgctatctgacggcacccgaacataaagaagatgtggcgttctcgattcagccggatgtcagcttcaactatttaggtcagtttgacgaaatgtcggatgcaggtttgtttacgagatcagagctgccatcaggacagtcattaagccctgaaacagaaaaaccgaatgcgctggatgttgtcggatatatcgaaaacggaaaactgacgatgtcactggcctatcattctcttgaatttcatgaaaaaacagtacaaacattcagtgacagctttaaagcgcatcttctcagaatcattgaacattgcctatctcaagacggtacggaactgaccccgagtgatcttggtgacgacgatttgacgctggatgagctggataaattaatggaaattttctaatagaggtggcatatgagcaaaaaatcgattcaaaaggtgtacgcactgacaccgatgcaggagggaatgctgtatcatgcgatgcttgatccgcattcttcctcgtacttcacacaattagagcttgggattcacggcgcttttgatcttgaaatctttgagaaaagcgtcaatgaactgattcggtcatacgatattctccgtacggtatttgtgcatcagcagctgcaaaaaccgcgtcaggtcgtgttagcggaacgcaaaacaaaggtgcattatgaggatatcagtcatgcagacgagaaccgccagaaagagcacattgagcgttacaaacaagacgttcagcgccaaggctttaacctggcaaaagacatattgttcaaggtagcggttttccgccttgatgcagatcagctgtatcttgtctggagcaatcatcatattatgatggacggctggagcatgggcgtcctcatgaaaagcctgttccaaaactatgaagcgctcagagcaggaaggacacctgcaaacggtcaaggcaagccttactccgactacatcaaatggcttggaaaacaggacaatgaagaagcggagagctactggagcgagcgcttggcgggttttgaacagcccagcgtgctcccgggccgcctgcctgtaaaaaaagacgaatacgtcaataaagaatattcctttacatgggacgaaacactggttgcccgcattcagaaaaccgcaaaccttcatcaagtgacagggcctaacctatttcaggccgtttgggggattgttctcagcaaatacaactttacggatgatgttgtcttcggaacggtcgtctcaggaaggccgtctgaaatcaatggaattgaaacgatggcggggctgtttatcaacaccattccagtgcgggtgaaagttgaacgagatgctgcattcgctgatattttcacagctgttcagcagcatgcagtagaggcagagcgttacgattacgtgccgctctatgagattcaaaaacgctcagctcttgatggcaatctcttaaaccatcttgtcgcgtttgaaaattatccgcttgatcaagagcttgaaaacggcagcatggaagaccgcctcgggttttcgattaaggtagaaagcgcatttgaacaaacgagcttcgatttcaacctgattgtgtatccgggcaaaacgtggaccgtcaaaattaaatataacggagccgcctttgattccgcttttatcgaacggacagcggagcaccttacccgcatgatggaagcagctgtcgatcagccggccgcttttgtgcgtgagtacgggcttgtgggagacgaagagcagcggcaaattgtcgaggtgtttaacagcacgaaagccgaactccctgcaggaatggctgttcaccaagtgtttgaagagcaagcgaaacggacgccggcgagcactgccgtcgtatatgaaggaaccgtgctgacgtaccgcgagctgaatgcagcggctaaccgtctggcgagaaagcttgtcgaacaaggccttcaaaaaggggaaacagcagcgattatgaacgatcgatcagtagaaaccgttgtcggcatgctggctgtgttaaaagcaggcgccgcatatgtgccgcttgatccagcgcttccgggggatcgtcttcgtttcatggcagaggacagctccgttcgaatggttttgaccggaaattcttatacagggcaggcacatcagctgcaggtgccggttcttacactggacataggcattgaagatggcgaagctgacaatctcaacctgccatccgccccgtctgatttggcgtacatcatgtacacatccggttcaacgggcaaaccgaaaggcgtcatgatcgaacataaaagcattctgcgcctcgtcaaaaatgccgggtacgttcctgttactgaagaggaccgcatggcgcaaacaggggcagtcagctttgatgccggaacgtttgaggtattcggcgcactgctgaatggcgcagcgctttatccggtcaaaaaagagacactgcttgatgcgaaacaatttgctgcattcctgcgtgagcaaagcatcacaactatgtggctgacatcacctttattcaaccagcttgctgcaaaggatgcgggtatgttcggcacactgcgccatttaatcatcggcggagatgcccttgtcccgcatattgtcagcaaagtaaaacaggcatcgccgtcgctttcattgtggaacggatacggcccgacagaaaacacgacgttttcaaccagttttctgatcgaccgcgagtatggcggctctatcccaatcgggaagccgatcggaaattccactgcctatattatggatgagcagcaatgcctgcagccaatcggcgcgcctggtgagctttgcgtaggcggaatcggtgtagcgcgtgggtatgtcaatctccctgagctgacggagaagcaatttctggaagacccgttcagaccgggtgagagaatttaccgcactggtgacttggcaagatggctgccggacggcaatatcgaatttttaggcagaatcgacaaccaagtgaaggtgcgcggcttccgaattgagcttggcgaaattgaaacaaaactgaacatggctgagcatgtgacagaagccgcggtgatcatccgcaagaacaaagcagacgaaaatgaaatttgcgcgtacttcacggcggatcgtgaagtggctgtgagtgagctgagaaaaacactgtctcagtctttgcctgactatatggtccctgcccacctgattcaaatggacagcctgccgctcacgccaaacgggaaaatcaacaaaaaggaactgcctgcaccgcaatcagaagccgtgcagccggaatacgcagcaccaaaaacagagagtgaaaagaaattagcggagatctgggaaggaatactcggcgtcaaagcaggcgttaccgataacttctttatgatcggcggccattctttgaaagcgatgatgatgacggcgaaaattcaagagcattttcataaggaagttccgataaaagtgctttttgaaaagccgactattcaagaactggcactgtatttggaagagaacgaaagcaaggaggagcagacgtttgaaccgatcaggcaagcatcttatcagcagcattatcctgtatccccggcccagcggagaatgtatatcctcaatcagcttggacaagcaaacacaagctacaacgtccccgctgtacttctgctggagggagaagtagataaagaccggcttgaaaacgcgattcagcaattaatcaaccggcacgaaatcctccgtacatcgtttgacatgatcgacggagaggttgtgcaaaccgttcataaaaacatatcgttccagctggaggctgccaagggacgggaagaagacgcggaagagataatcaaagcatttgttcagccgtttgaattaaactgcgcgccgctcgtccgttcgaagcttgtccagctggaagaaaaacgccacctactgctcattgatatgcatcatattattactgacggcagttcaacaggcattctaatcggtgatcttgccaaaatatatcaaggcgctgatctggaactgctacaaattcactataaagattacgcagtttggcacaaagaacaaactaattatcaaaaagatgaggaatactggctcgatgtctttaaaggcgaactgccaatactggatcttcccgcggatttcgagcggccagctgaacggagctttgcgggagagcgcgtgatgtttgggcttgataagcaaatcacggctcaaatcaaatcgctcatggcagaaacagatacgacgatgtacatgtttttgctggcggcgttcaatgtactcctttccaagtacgcgtcacaggatgatatcattgttggctcgccgacagctggcagaacacatcctgatctgcaaggtgtgccgggtatgtttgtcaacacggtggcactcagaacggcaccagcgggagataaaaccttcgcgcaattccttgaagaggtcaaaacagccagccttcaagcattcgagcaccagagctatccgcttgaggagctgattgaaaagcttccgcttacaagggatacaagcagaagtccgctgttcagcgtgatgttcaacatgcagaatatggagattccttcattaagattaggagatttgaagatttcctcgtattccatgcttcatcatgttgcgaaatttgatctttccttggaagcggtcgagcgtgaagaggatatcggcctaagctttgactatgcgactgccttgtttaaggacgagacgatccgccgctggagccgccactttgtcaatatcatcaaagcggccgcggctaatccgaacgttcggctgtctgatgtagatctgctttcatctgcagaaacggctgctttgctagaagaaagacatatgactcaaattaccgaagcaacctttgcagctctttttgaaaaacaggcccagcaaacacctgaccaccctgcggtgaaggctggcggaaatctgctgacctatcgcgagcttgatgaacaggcgaaccagctagcgcatcatcttcgtgcccaaggggccggaaatgaagacattgtcgcgattgttatggaccggtcagctgaagtcatggtatccattctcggtgtcatgaaggcgggggcagctttccttccgattgatcctgatacacccgaagaacgaatccgttattcattagaggacagcggagcaaaatttgcggtcgtgaatgaaagaaacatgacggctattgggcaatatgaagggacaatcgtcagccttgatgacggtaaatggagaaatgaaagcaaggagcgcccatcatccatttccgggtctcgcaatcttgcatacgtcatttatacgtccggtacgaccggaaagccaaagggcgtgcagattgagcatcgcaatctgacaaactatgtctcttggtttagtgaagaggcgagcctgacggaaaatgataagactgtattgctttcatcttacgcatttgaccttggctatacgagcatgttccccgtacttctgggcgggggcgagctccatatcgtccagaaggaaacctatacggcgccggatgaaatagcgcactatatcaaggagcatgggatcacttatatcaaactgacaccgtctctcttccatacaatagtgaacaccgccagttttgcaaaagatgcgaaatttgaatccttgcgcttgatcgtcttgggaggagaaaaaatcatcccgactgatgttctcgccttccgtaagatgtatggacataccgaatttatcaatcactacggcccgacagaagcaacgatcggcgccatcgccgggcgggttgatctgtctgagccggatgcatttgcgaaacgcccgacaatcggacgcccgattgcgaatgccggcgcgcttgtcttaaatgaagcattgaagcttgtgccgccgggagcgagcggacagctctatatcacgggacaggggcttgcgagagggtatctcaacaggcctcagctgacagccgagagatttgtagaaaatccatattcgccgggaagcctcatgtacaaaaccggagatgtcgtacgaagactttctgacggtacgcttgcatttatcggccgggctgatgatcaggtgaaaatccgcggctaccgcattgagccgaaagaaattgaaacggtcatgctcagcctcagcggaattcaagaagcggttgtactagcggtttccgagggcggtcttcaagagctttgcgcgtattatacgtcggatcaagctattgaaaaagcagagctccggaagcagctttccctaacactgccgtctcatatgattcctgctttctttgtgcaggttgacgcgattccgctgacggcaaacggaaaaaccgacagaaacgctttgccaaagccgaacgcggcacaatccggtggcaaagccttggccgcaccggagacagcgcttgaagaaagcttatgccgcatttggcagaaaacgcttggcatagaagccatcggcattgacgacaattttttcgatttaggcggccattcattaaaagggatgatgctgattgccaacattcaggcggaattggagaaaagcgtaccgcttaaagcactgttcgagcagccgactgttcgccagctggcggcttatatggaggcgtctgctgtttcaggcggccatcaagtcctcaaaccggctgacaagcaggatatgtatccattgtcatccgcacagaaacggatgtacgtgctcaatcagcttgaccgccagacgataagctacaacatgccatctgttcttctaatggaaggagagcttgatatttcgtgcctgcgcgattcactcaatcagcttgtgaaccgtcacgaatcattgcggacgtcatttatggaagctaatggtgagcctgttcagcgcatcattgagaaggcggaggttgatcttcatgtgtttgaagccaaagaagacgaagcggaccaaaagattaaggaatttatccggccattcgacttaaacgacgcaccgctcattcgcgcagctttgcttcgaatagaagcgaaaaaacatttgctgcttttagatatgcatcatatcatcgcagacggcgtctcaagaggcatttttgtaaaagaattggcgctgctttacaaaggagagcagcttccggagccggcgcttcattataaagatttcgccgtttggcaacatgaagctgagcaaaaagaacggatgaaggagcatgaggcgtactggatgtcagttctttcaggcgagctgccagagcttgatctcccgctcgattacgcccgtccgcctgtgcaaagctttaaaggagatacgatccgtttccgtacgggaagtgagacggcaaaggcggtagaaaaactgcttgcggaaaccggaacgaccttgcacatggtgctccatgctgttttccacgtctttttaagcaaaatttccggacagcgggatatcgtcatcggctccgttactgccggccggacgaatgctgatgttcaggacatgccgggaatgttcgtcaatacacttgccctgagaatggaagcgaaagaacagcaaacatttgcggagcttttggagcaagcaaagcagacgaacctgtcagcgcttgagcatcaggagtatccgtttgaagatctggttaatcagcttgatctccctcgggatatgagccgaaacccattgtttaatgtgatggtgacgacagaaaaccctgataaagaacagcttacattgcaaaatctgagcatttcaccttatgaggctcatcagggaacttctaagtttgatctgacactgggcggatttactgatgaaaatggcattggcttgcagctcgaatatgcgacagatctgttcgcgaaagaaacagctgaaaaatggagcgaatacgttctgcggctactaaaggctgttgcggataacccgaaccagccgctttccagcctgtcactggtcaccgagacagaaaaacaagcacttcttgaggcatggaagggcaaagcgctgcctgtgccgacagacaaaacggttcatcagctattcgaagagactgtccagcgccacaaagaccgcccggctgtcacatacaacggccagtcttggacgtacggtgagctgaatgcgaaggcgaatcgtctcgcgcggattctgatggactgcggcatcagcccggatgaccgcgtcggcattctcacgaagccgtcgcttgaaatgtccgccgcggtgctcggcgtcttgaaagccggagcggcgtttgtgccgattgatcctgactacccggatcagcggattgagtatattttacaggacagcggcgcgaagcttctcttgaaacaggaaggcatttcagtgccggacagctttacgggagatgtcattcttctcgacggaagccgcacgattctaagcctgccgcttgatgaaaacgacgagggaaatccagaaaccgctgtaaccgcggagaacttggcgtacatgatttacacgtctggaacgaccggacagccgaagggtgtcatggttgagcaccatgcgcttgtgaacctgtgcttctggcaccacgacgcgttcagcatgacagcggaggaccgcagtgcgaagtacgcgggctttgggttcgacgcttccatttgggagatgttcccgacttggacgatcggcgctgagcttcacgtcattgatgaagcgatccgcctcgatatcgtccgcctgaacgattattttgaaacgaacggcgtaacgatcacgttcctgccgacacagcttgcggaacagttcatggagcttgagaacacatcacttcgcgtcctcttgaccggaggagacaagctgaagcgcgcagtgaaaaagccgtacacactcgtcaataactacgggccgacagaaaatacggtcgttgccacaagcgcagaaatccatccggaggaaggctcgctttccatcggaagggccattgccaatacgagagtatacattctcggcgagggcaatcaggtgcagccggaaggcgtagccggagagctttgcgtggcggggcgcggactggcacgaggctatctgaatcgagaagacgaaaccgcgaagcggtttgtcgctgatccgtttgtgccgggtgagcgcatgtaccgcaccggcgatttggtgaaatggacgggcagcggcatcgaatacatcggccggatcgaccagcaggtcaaggtccgcggctaccggatcgagctttcagaaattgaagtccagctcgcccagctttctgaggtgcaggatgcggcggtgacagctgtcaaggataaaggcggcaatacagcaatcgcggcgtatgtcacaccggaaacagctgacatagaagcactaaaatcagcactaaaggaaaccctgccggattacatgatcccggcgttctgggtgacgctgaacgagcttccggttacggcaaacggcaaagtggaccgcaaagccttgcctgagccggacatcgaagcgggaagcggagaatacaaagcgccgacgaccgacatggaagagctgcttgccggcatctggcaggacgtgcttggaatgtctgaagtcggtgtcaccgacaatttcttctcgcttggcggagattccatcaaaggaattcaaatggcgagccgcttgaatcagcacggctggaggctggaaatgaaagatctcttccagcatccgacgatcgaagagcttacccaatatgtagagcgtgccgaaggcaaacaggcagaccaaggcccggtagagggcgaagtcatcctgacgccgatccagcgctggttctttgaaaagaacttcacgaacaagcaccactggaaccaatcggtgatgcttcacgccgcgaagggctttgaccctgaacgggtggagaaaacattgcaggcgctgatcgagcatcatgacgcgctccgcatggtctaccgcgaggaaaacggggacatcgttcaggtgtataaaccgatcggtgagagcaaggtcagcttcgaaatcgtggatctgtacggctccgatgaagagatgctgagaagccagattaagcttctcgcgaacaagctgcaaagcagtctcgatctgcgaaacgggccgcttttaaaggcggagcaatatcgcacagaagctggggatcacctgctcattgctgtacaccatctcgtggtcgacggtgtgtcatggcggattttgcttgaagactttgcttcaggctacatgcaggctgagaaagaagagagccttgtcttcccgcaaaaaacaaactccttcaaggattgggcggaagaactggcggcattcagccaatcagcgcatcttttacagcaggctgaatactggtcgcaaattgccgctgaacaggtttctcctttaccaaaggattgtgaaacagagcagcggatcgtcaaggatacatcatccgtcctatgtgaattaacggaagaagacactaagcatcttttaacagatgttcatcagccatatggaactgaaatcaacgatattcttctcagcgcgctcggtttgacaatgaaagaatggacaaagggggccaaaattggcattaaccttgagggacacggccgggaggacatcatcccgaatgtgaatatctccagaacggtcggctggtttacggcacaataccctgttgtgctcgacatgtctgaagcagatgcctcagctgtgatcaaaacagtcaaagaaaacctgcgccgcattccggacaaaggtgttggctacggcattcttcgttatttcacagaaacagcggaaacaaagggcttcacaccggagatcagcttcaactatttgggccaattcgacagtgaagtcaaaaccgatttctttgaaccgtccgctttcgatatggggcgccaagtaagcggagaatcagaggcgctgtacgcattaagcttcagcggcatgatcagaaacggccggtttgtgctttcctgctcctacaatgagaaggagtttgaaagagctacagtcgaggagcaaatggaacggtttaaagaaaacctcctgatgctaatccgccattgcacggaaaaagaagacaaggaattcacaccaagcgacttcagcgccgaagaccttgaaatggacgagatgggagatatctttgacatgcttgaggagaatttaaaataaaacgcaagggaattacagaaggcgggagcgaaacatatgagtcaatttagcaaggatcaggttcaagatatgtattacctatcgccgatgcaggaagggatgctttttcatgccatcctgaatcccggccaaagcttttaccttgaacaaatcacgatgaaagtaaaaggtagcttgaatatcaaatgtcttgaagaaagcatgaatgtgatcatggaccggtacgatgtatttcgtaccgtgttcattcacgaaaaagtaaaaaggcctgtccaagtcgtattgaaaaaacggcagttccaaatagaagaaatcgatctgacacacttaacgggcagcgagcaaacagccaaaatcaatgagtacaaagaacaggataagatcaggggttttgatttgacgcgggatattccgatgcgggcagccattttcaagaaagctgaagaaagctttgaatgggtgtggagctaccaccacattattttggacggatggtgcttcggcatcgtcgtacaggatctatttaaggtatacaatgctctgcgcgaacaaaagccgtacagcctgcccccgtcaaaccgtataaagactacatcaagtggcttgaaaagcaggataaacaagcatcactgcgttactggcgcgagtatttagaggactttgaaggacaaacgacgtttgcggagcaaagaaagaaacaaaaggacggctatgagccgaaagagctgctcttttcactgccggaggcggaaacaaaggcctttaccgagcttgcaaaatcgcagcataccactttaagtacggcgctgcaggcagtctggagcgtattgatcagccgctatcagcagtctggcgatttggccttcggtacagttgtttcagggcgtcccgcggaaatcaaaggcgttgaacatatggtcgggctgtttatcaacgttgtcccgagacgtgtgaagctgtctgagggtatcacatttaacggcttgctcaagcagctgcaggagcaatcgctgcagtctgagccgcaccaatatgtgccgctttatgacatccaaagccaggccgatcagccgaaactgattgaccacatcattgtttttgagaactatccgcttcaggatgcgaaaaatgaagaaagcagtgaaaacggctttgatatggtggatgttcatgtttttgagaagtcgaattatgatctcaacctgatggcttcccctggagatgagatgctgattaagcttgcctataatgagaatgtgtttgatgaggcgtttatcctgcgcttgaaatctcagcttctcacagcaattcagcagctcatccagaatcctgatcagcctgtcagcacgatcaacctcgttgacgacagggagagagaatttttgctaaccggcttaaacccgccggctcaagctcatgaaacaaagcctctgacggattggttcaaggaagcagtgaacgtcaatccggatgcgccggcgcttacgtattccggccagaccctgtcttatcgcgaattagatgaggaagcgaaccgccttgcacgccggctgcaaaaacacggtgcgggcaaaggctctgttgtagcgctgtacacgaagcgctcacttgaactggtaatcggcattctcggtgtattaaaggcgggagcagcctatctgccggttgatccgaagctgccagaggaccgaatctcgtatatgctggctgacagtgcggcagcctgtcttctgacgcatcagaagatgaaagaacaagcggctgagctgccgtatacaggcacaacgctcttcattgatgatcaaacacggtttgaagaacaggcaagcgatcctgcaaccgcgattgatcctaatgatccggcatatatcatgtacacgtccggcacaaccggaaagccaaagggcaatatcaccactcatgccaatattcaaggattggtcaagcatgtagactacatggcattctctgagaaagatacattcttatctgtttccaattacgcctttgacgcatttacctttgatttctatgcttctatgctgaatgcggcacggctcattatcgcagatgaacatacgctgcttgatacagaacggctcacagatctgatcctgcaagagaatgtcaatgtcatgtttgcgacaaccgcactatttaatcttctcacggatgcgggagaggattggatgaagggactacgctgtatattattcggcggagagcgcgcgtcagtgcctcatgtcagaaaagcgctgcgggtcatggggccgggcaagctgattaactgctacgggccgactgagggaacagtgtttgcgactgctcacgtcgtgcatgatataccggattccatctcctcattgccgatcggaaagccgatcagcaatgccagtgtttatattctgaacgagcaaagccagctccagccattcggggcgatcggtgaactgtgcatcagcggaatgggcgtgtcaaaaggatatgtaaatcgtgctgacctcacgaaggaaaagtttattaagaacccgttcaagccgggagaaacgctttaccgcacaggggatttagcgcgctggctgccggatggaacgattgaatacgccggccgtattgacgaccaggtcaaaatacgtggacaccggattgagcttgaagaaatcgaaaagcagctgcaggaatacccaggtgtgaaagatgcggtcgttgtggcggaccgccctgagtctggcgatgcatcaatcaatgcctaccttgtgaaccgaacgcagctttcagctgaagacgtgaaggcgcacctgaaaaaacagcttcctgcttacatggtgccgcaaacctttaccttcttggatgagcttcctttaacgacgaacgggaaagtcaataaacggctgctcccaaaacctgatcaggatcagctggcggaagaatggattggaccgcggaacgagatggaagaaacaatcgcacaaatatggtctgaggttctcggcagaaagcaaattggcattcatgacgatttctttgcgctcggagggcattccttgaaggccatgaccgccgcgtcccgcatcaagaaagagctcgggattgatcttccagtaaagcttttgtttgaagcgccgacgatcgccggcatttcagcgtatttgaaaaacgggggccctgatggcttgcaggatgtaacgataatgaatcaggatcaggagcagatcattttcgcattcccgccggtcttgggctatggccttatgtaccaaaatctgtccagccgcttgccgtcatacaagctgtgcgcctttgattttattgaggaggaagaccggcttgaccgctatgcggatttgatccagaagctgcagccggaagggcctttaacattgtttgggtattcagcgggatgcagcctggcgtttgaagctgcgaaaaagcttgaggaacaaggccgtattgttcagcggatcatcatggtcgattcctataaaaaacaaggtgtcagtgatctggacggacgcacggttgaaagtgatgtcgaagcgttgatgaatgtcaatcgggacaatgaagcgctcaacagcgaagccgtcaaacaaggcctcaagcaaaaaacacatgccttttactcatactacgtcaatctgatcagcacaggccaggtgaaagcagatattgatctgctgacttccggcgctgattttgacatgccggaatggcttgcatcatgggaagaagctacaacaggtgcttaccgtatgaaaagaggcttcggaacacacgcagaaatgctgcagggcgaaacgctagataggaatgccgggattttgctcgaatttcttaatacacaaaccgtaacggtttcataaatgaagtgatgaaaggaggagacagccaatgagccaactcttcaaatcatttgatgcgtcggaaaaaacacagctcatctgttttccgtttgccggcggctattcggcgtcgtttcgccctctccatgcttttttgcagggggagtgcgagatgctcgctgccgagccgccgggacacggcacgaatcaaacgtcagccattgaggatctcgaagagctgacggatttgtacaagcaagaactgaaccttcgccctgatcggccgtttgtgctgttcggacacagtatgggcggaatgatcaccttcaggctggcacaaaagcttgagcgtgaaggcatctttccgcaggcggttatcatttctgcaatccagccgcctcatattcagcggaagaaagtgtcccacctgcctgatgatcagtttctcgatcatattatccaattaggcggaatgcccgcagagcttgttgaaaataaggaggtcatgtcctttttcctgccttctttccgatcagattaccgggctcttgaacaatttgagctttacgatctggcccagattcagtcgcctgttcatgtctttaacgggcttgatgataaaaaatgcatacgagatgcggaaggctggaagaagtgggcaaaagacatcacattccatcaatttgacggcgggcacatgttcctgctgtcacaaacggaagaagtcgcagaacggatttttgcgatcttgaatcagcatccgatcattcaaccgtgatcaaaagcggacagcttcggctgttccgctttttttgtgttgaatgccaatttttgcatggtataatagtcgaaatactcaaataaaggcaggtcgaaacatgcgcacgtctcccaggatgaaatggtttgtattgctgtttacgtttgttttcgccatcggaatgaactcattcagaaattcctttcaattttttatgctgccaatggcagatgccttccatgccgacaggtcgctgatctcggtttctgtcagcatttttatgatcacaaccggcatcgtccagttttttgtcggtttttttatcgaccgtttcagtgtcagaaaaattatggcgctgggagctgtctgcatcagcgcaagctttttggtgcttccttattcaccgaatgttcatgtgttttccgccatttacggtgtgcttggcggaatcggctattcctgcgcggtcggcgtgacgacccagtacttcatcagccgttggtttgacacacataaaggtctggcgcttgctattttgaccaatgccaactctgcgggcctgctgcttctctcgcccatttgggctgcggctccgtatcatgccggctggcagagcacctataccattttgggaatcgtcatggcggctgttctgctgccgctcctcgtctttgggatgaagcacccgccacatgcgcaagcggaaactgtgaaaaaatcttatgattggcgagggttttggaacgtgatgaagcaatcccgcctcattcatatcctgtacttcggcgtgtttacttgcggatttacaatgggaattattgatgctcacctcgtcccgatactgaaggatgcgcatgtctctcatgtcaacggaatgatggccgcgttcggggcatttatcatcattggcggattattggcgggctggctgtcagatctcctcggcagcagaagcgtcatgctatccatcttatttttcattcggctgctcagcctcatttgcctgctcattcccattctcggaattcatcacagcgacctttggtacttcgggtttatcctgttattcgggctcagttacacaggcgtgatcccgctgaccgcggcgtcaatttcggaaagctatcaaacaggattgatcggatcgctgttaggcatcaatttctttatccatcaggttgccggagctcttagcgtgtatgcgggcggtttgttttttgacatgactcatggttatttgctgattgtcgctgtgtgcatcgtgtttgtgggtttatcggctgtaatagagctggtgccgtttttagataaacagaaggcaaaagaaacccaccattcaatataaaaggatcagcactgtcaatgctgatcctttttaaatttgagtttttttgtttcggtatttttaaggataatctccttgaatctgttcatctcctcttcggagtgaaaaaaatgtttggggatcgcaatatattggccacttgatgtattgaccctgaagatatttttatattcgaaaacagctgtaatttcatcccaattgaaaatgaggtcatattttttagaacatatacgaattccttcttggttcagagtatatgttcttttagatttcatccgttcgttcttcttgtatgctctggaaaacttcacatatagaagaaggaggagcagcagtgtaaacagaacggacatcacgataatcaacatactgttcataaacaagttaagcgcgtcactgccataaacgatacggggccatccgttaatgaagttaactgcagcaaatatggtgcaaaacaacagaaagtaaaagcatgatatttttgcgatttgataaaaaaagatttctcttacatccttaaaagcgatttctcctggaagattgatactttcactagcatattgaatcatacggtaaacctacacctctaaccatgtttttcctttcagtctagcataatttctcatttttttgcaggcataccagggcgctttgtttttttctccagattgatattgctccccaccacgccaatcataatacaaacagccccggcaagatgataccaggccaggctttcgttgagaatcataactcctgcaatcatcgtcacaatggtagatacatgattaaaagcactcattttaaacgcctcaattcgcgacagcgtatagttagacagaaatgaagtgacaagtgaagacagcacgcccaaatacacaatggcgagaacgaagccgggctcccggaacggcagaaaataagtgccgactgttcccgccgctccgtgacgcacaagggcgatggcgttgaagacgacaaagccgatggctgacatgatgtaggtgagctcggtcagcttgaaccgctgcgtcatttttctggcagcagtattgtacatcgctgaggacaaagcggacaataggatcagcaaagacccttttaagctggctgattccacgtcaacgcctttcatcacaaaaataaacatgacgccggcaacggataaaaccgtgaaccccttttgggtccacgttgggcgttcctttaaaacataagcggcaaagaccatcgtgaaaatcggaatggctgcctgaataattcccgcttcagaggaggacgagtacacaaggccaaatgcctgaaagctgaaaaataacgcgggatacagcagggcgagcggcaaaatggcaatgacgtcctttacgcggattgatagctttacccagccgaataagatcggtacagtggccgcagcaaacgcaatggtgaaccgatgcgccaaaatatcaaacggctctgctgtttgcagtgcgatttttacgaatagaaaggataaaccgataatgaacgaatataaaatagccgctatataagcgggggcttgctgatgtttaaccataatgggaatggctcctttacctgaattgcagcgccggtcgctccctttattgtatggccgcggtcagaacggtacaatgagaaaaacaatgaactgtaccggtacaaaacagggggagaaggcatggagaaatatatgagtctattaacgaagatagaggagatgatgcaaagcaccgcctatcaagaaggagacaggcttccatctatccgtcagctgtccgcccgctaccaagtcagcaaaagcacagtgatccgcgcgctgcaggagctggaaaaacgccaccttatctattccgttccgaaaagcggctattatattgtgaaaaagacgggaaaagccaaaagcgggcagcagggtcccattgactttgccacatctgcgccggatccagatgtgtttccgtatcttgattttcagcactgcatcaacaaagcgattgatacatacaaaaacgatttgtttatttatgggacgccaaaggggcttccatcactcatccgcgtactccgaaagctcttggccactcaacaggtatttgcggatgaacggcatattttcattacatcaggtgtccagcaggcgttatccttgctttgtgccatgccgttcccaaatgggaaagagaagatcgccattgaacagccgggctaccatttgatggtcgaacagcttgagacgcttgggattcccgccatcggggtgaaacgaacggaagaagggcttgatatagccgaggttgagcggttatttcaaacagaatcgattaaatttttttatacgatgccccgcttccataacccgcttggctgctctttgtcagagcgtgataaacaggagcttgtgagactggcagaagcgtatgatgtctacctcgttgaggatgattacctcggtgatctggaggaaaataaaaaggcagatccgctgtacgcatatgatctgtcctcacatgtcatctatttgaaaagcttctcgaaaatgatgttccccggccttcgcgtgggggcggctgttttgcccgaagcgctgactgacacgttctatgcgtacaaaaagctgaacgacatcgactgttcgatgatttctcaagcggcattggagatttacctgaaaagcggtatgtacggcaggcataaggagaaaatcagaaattcttataaagagcggtcgctgaggctacatcaagccattcaaacacacaggcagctgggaagcggacgctttacgttctccagcgggcaggcaccctgtatgcacacccatctggtgcttcctcaggatctgcccgcctcaagagtgattcatagactggaaaaacaaggggttctccttgtggcgatagaccgtcattatttatcagattatccgaaagaaaatctattaaaaatcaatatttccaatgtgaaaacggaagatattgagcgcggtgtcaagctgttgatgagccatttataaaagctcttcgtacgagaccattgtgatatcctcggggaaatcagggtgtgcggcgcatacagccattttgtagccgggatcgacctcatacgttttgatatagcatggggaatggctgtccggaagctcaatggatacttgtccgtcctggtgcaggcgcactgaaaaggaatcaagcggaagcgataagcctttgccttcctgtttgataaagctttctttcattgaccatagatgataaaaatagtctgtctgctcgtccttgtcttttgctaaaaggtcgctgtactctgtttttgaaaagaagcgcttggcgatctcaaggctgatcggtttcgttttttcgatatctatgccgatcggctgtgaatcaaacgcgcaaatgacccagcgtccggagtgagaaatgttgaaatgagcgtcgggaagatcagggatgcacggcttcccgtattcctgcgtgctaaagcggatatcggatttgtccaactgatactgcctgcttatgactgagcgaacgagcacatctcccagcagggtgcggtgagcatcttctttatgataaaatctccggcatttctcccgtttttcaggtgctatgaaagacatgaaccgttcattttcttcctgtgaaagcgggcggtccatataaattccgtaaatcttcattctagatcctccgtctgcaaaagattgtcaaaaccatcctatcatacttccacaagactcatatagaggagaaaataaaaaaacaaagccaaggcggctttgttttagtggacaggcggagatgctttcacagcggctgtccgccttgccacagcataattcagcagctggattgactgcggcaatgaaaaacgcagaatgagcccggtgaggatggcggtcaaaatggtgccaaaaccgatcggcccacccatgccccatgccgcaaacaaaatggttaattccatgccgttccgcacccattgcacattccagccggttttttctgtaatcagcatcatcagtgaatcacgcggccccgcgccaaggcctgctgatacataaacaccgacgccgtaaccgatcagcaccacgccgagagagaagacgatgatcgagcctgtgtaggtcgagggggcaggcagaatgaaattgaaaaaatctataaatacaccaatgagcaccatattcaggagggccccaattttcggccaagctctcgtaaacaatgacgtgaatccgacgatgagcgctccaataatgatggaccactggccgacggtaagcccgaagtgctgaaacaggctgtaatgaaatgcatcccacggactaatgccgagtgcttttccttctatcgtcagggatacaccaaaagccaaaatgatcaaaccggcaaaataaaatgtccagcgcagaacaagttcttgcttcacgtgaggtcccttctttcgtaaaaatcagtcgattgtcattgtagcacatctgacagaagggcggaataggcgaaaggggctcaacaaaaaaacagggccgccgcaggcgccctgtttcagcgtgttggtaaacccttgcattcgttgtcaggcctgtgcttcggtgctcacgaatttaacattcgctgtgctccaatgctcgcccttcctagacttcaaaggttttcaatcacgctgaaaatcacaaaatcctaaaacgaatatcgttttaggattttgtcaataatctgaaacagggcgcgggcgccctgtttttcttattacagcgggttcaaaatccggttcaagaaccgctgtgtccgttcttcttttggtgcggagaaaatttgctccggcggtccttgctccacgataacgccgccgtcgatgaagatgacttcatccgcaacctcctgcgcgaacttgatttcgtgggtcacgacgaccatggtccagccttcattggccaagtccttgataaccttcagcacctctccgacaagctcgggatcaagcgctgaggtcggttcgtcaaacagcatgagctcaggctgaatcgccagtgcgcgggcgatgccgacgcgctgctgctgtccgccggaaagctggaacggatataaatccattttgtccttcaatccgactttatcaagaagctgaatcgcttcttttctgacttcctctttgttccgtttttgcacctgaacagggccctccatcacgttttcgagggctgtgcggtgcgggaacaggtgatacgcctgaaacaccattccggattttcggcgaagctttaggatatccgcctgtttcacctttttggagaaatcgatggagaaatcatcaaatgcaagctctccgcgattcgggatctccagagcgttcaggcagcggagcagcgtcgttttccctgaacctgaaggcccaagtatggcgatgacttttcctttttcaatcttcatatctatcttttttaaaatttcattttcaccgaatgatttgtttaatcctttaacggtaagcatactcggaacctccttatttggccacgtagcggtcaagacgccgttcgatgacatgctggacgagtgagagcaggaagcagataatccaataaataaaggctgcttcaatatagatcactaaaatttgatcaagattccgcgcgccgatttcctgggcttttctgaacagctcagcgaccagaatttgagaggcgagggatgtatctttaatcaggctgataaaggtattggataatggcgggatcgacacacgaaacgcctgcggcaaaatgacgcggaacagcgttttttgatgtgtcatgccaattgtgtagccggcttcccattgccctttcggcacggataaaatagatgctcgaatgatttcagatgcataggcgccgacgtttaatgaaaaggcgataactgcgcttggaaatggatctaatgtgacgttaaaggccgggaacagatagaaaatgatgaacaattgaacgagaagaggagtgccgcgtattgcggatacgtatacgctgaacacccatctcaaaggtctcactttcgacattctggcaagcgccgtaatcagcgccaggatcattccgaatataaaggaaagaatcgtaaggggaatcgtatagtagattccccctgaaagtatcggccagaatgactgctgcaccagatcccacgggatcgccgtgccaagcgtcaatgccggcagattatttagaaacatcttcgccgaaccattttttagaaattttagaaagagtcccgtcctctttcatttcttttaatgctttgttgacttgatcaacaacctcgccgcttcctttacggaacgtgaaatatgttgactgaggctcacctgtttcaaacgcgattttcacgtttttattgccagatgtttttaagtagttcaatacggcaagcttatcgttgtatgtcatatcgacgcggccttgctggatcatttgaagggcctgcgccataccttcaacgccttctactttagcgccggcatttgtagctaatttgttgtagttgcttgtcagtgattgagctgacgtttttccttttacatctgcttcagacttaatatcgttgttgtcttttttcgttacgacaacggctcttgatgttgtgtatttatctgagaaatcatattgattttcacgatctgtttttccgacttggttggcaacaacgtcaaaccgtttggaattcaggccggcaaacatactgtcccactgtgtttccttaaagtcgactttaagcccgaggcgttttgcgacttctgtgataacttcgacatcatagccagtcagtttatcagtgtctttgtcgtggtaagtgaacggctcatatgttccttccgttccgactgtgagcacaccttttttcttaattgaagcccaaagatcgccatctttggcattatcttttgactgattgtcatttcctgctccgcaagctgcaagagctgcaatacttacgaccatgaataaagccaataatgcttttttcatcttattccccacttttctggttgattttattgaaataaaaaaatagcttacaaatctaaaggataacttttttttagtatgagtcaagtaattggttttcataaggcaaaatcttttaaaataaatccaaaaattgctgtgccggtttaggcaaataactgtccgttctccacatgacagccggtgtcataatgaagggattattttcgatatgaacggtgcgaacgtgatttctcatatgaacgggaatcattgtgacgggcaaaatagacgcgccgaatccggatgacacgaggctgagcaaagttgcagagtcgtggcattcacaaacaatgcgcggctccaggttcaaacgatgaaattcattcatgacctgattataaacgccttttccgttgacaggccgcagcaggatcagcggaaatgaaggaatgtcctccatcttaatggtgtctccgcacggatatccggcttcatctgaaagcacgagcacacatggaatgtcatcaagctgtttgaattgtactgtgtcacttttgatcagtgttgtcgtgaccgccgcatcgatttgccggctttccagcagctccaacagtgtcgcgggttcattttcccaaatattaaaggtgagatgggggtatctctctttgatctgtgttactttttcaagcatcagagccgcgcaataaatcgttgatcccacggcaagtgtgccggctacttcctccttcagctcctgtacctcaatgactgcatcttcaaacctatgcagaatctcttttgctctttttagaaaaacagctccttcatatgtaagagtcatttgttttttcttgttacggtcaaacagaacaacaccaagttcgtcctccagctgtttgagctgcctgcttaaaggcggctgcgccatgtgaagctttttggctgcggacgtaattttctgttcttgggcaatggtaatgaagtatcgaagctggcgaatatccaaaagaaagcgcctccttatcataccttttaggtattaaatatagatttaatagatatttttcatatggatatatcaggagtatgattgaaatgaaagcagaattcaagcgtaaaggagggggcaaagtgaaactcgttgtcggaatgacaggggcaacaggggccattttcggggtcaggctgctacagtggctgaaggccgccggagtggaaacccatctcgttgtgtctccttgggcaaacgtcacgatcaaacacgaaacaggctataccttacaagaagtagaacaactggccacatacacttactcacataaggatcaggcggcagccatttcaagcgggtcgtttgataccgatggaatgattgttgcgccgtgcagcatgaagtctctcgcaagcattcgcaccggaatggcggataatctgctgacacgtgcggcggatgtcatgctcaaggagagaaaaaaactcgtcctcttaacgagagagacgcctttgaaccaaattcatctcgaaaatatgctagcgcttacgaaaatgggcaccatcattcttcctccgatgccggcattttataatcagccgagaagcttagaggaaatggttgaccatattgtttttagaacgttggaccaattcggcattcggcttcctgaagcgaagcgctggaatgggattgaaaaacaaaaaggaggagcttgatcatggcttatcaagatttcagagaatttctcgctgcccttgaaaaagaaggacagctgcttacagtgaatgaagaggtaaagccggaaccggatttaggggccgccgcacgggcagccagcaatcttggcgataaaagccctgcgctcttatttaacaacatttacggctatcataacgcgcgaattgcgatgaatgtcatcggctcttggccaaaccatgccatgatgctgggcatgccgaaagacacaccggtaaaagaacagttttttgaattcgcaaagcgttatgaccagtttccgatgccggtcaaacgtgaggaaacagcgccatttcatgaaaatgaaatcacagaagatatcaatttgttcgatatactgcctcttttcagaattaaccagggtgatggaggctactatttagacaaagcatgtgtcatttcccgtgatcttgaggaccctgacaacttcggcaaacaaaatgtcggcatttacagaatgcaggtcaaaggaaaagaccgtctcggcattcagcctgtcccgcagcacgatattgcaatccatctgcgccaagctgaagaacgcggcatcaatcttccggtcaccattgcgctcggctgtgagccggtcattacaacggcggcatcgactccgcttctctatgatcaatcagaatacgaaatggcaggcgcgattcaaggcgaaccatatcgcatcgtcaaatcaaagctgtctgatcttgatgttccgtggggcgctgaagtggtgcttgaaggtgagattattgccggagagcgcgaatatgaagggccgttcggtgaattcacaggccattattccggcggacgcagcatgccgattatcaaaattaaacgcgtctatcacagaaacaatccgatctttgaacatttatacttaggcatgccttggacagaatgcgattacatgatcggcattaacacatgcgtgccgctttatcagcagttaaaagaagcgtacccgaacgaaattgtggcagtgaacgccatgtacacacacggtttaatcgcgattgtttccacaaaaacccgctatggcgggtttgcgaaagcggtcggcatgcgcgcactcacaacgccgcacggactcggctactgcaaaatggtcattgtcgttgatgaggatgtcgatccattcaaccttccgcaggtcatgtgggcgctttcgaccaaaatgcatccgaaacacgatgcggtcatcattccggacttatctgtcctgccgcttgatccgggatccaatccatcaggaatcactcacaaaatgattcttgacgccactacaccggttgcgccggaaacaagaggccattattcacagccgcttgattcgccgctaacaacgaaagaatgggaacaaaaactaatggacttaatgaataaataaggaaaggatgttcgaaatgcatacatgtcctcgatgcgactcaaaaaagggagaagtcatgagcaaatcgcctgtagaaggcgcatgggaagtttatcagtgccaaacatgcttttttacatggagatcctgtgaaccggaaagcattacaaatcccgaaaaatacaatccagcgtttaaaattgatccaaaggaaacagaaacagcaattgaagttccggcggtgccggaacgaaaggcttgatccgcgtgaactgtatgtcagaccgcctctttgagctgcttgacgggagctgcctgaatgagaagcagcatgaggccttcgttctgcaaacagtatcagaggatggctggccgcatgccgctatgatcagtgcaggtgaaattatcgcgctgagccgaattgatatccgaatcgctctgtggaaaaacacaatgacttcggccaacatccttcgcacaggaaaagcacagttcacggcgtggtggaagggagcggcctattatgtaaagcttgaatgcgcgcctttaccgcctttgaatgatgctgaatatgatagagaccgtttttcctgccgcatcgtttcagtgaaggaggacgttgcgaaatacgctgatttgacttcaggtgtccgtatacagcttcacagccctgaagaggtgctgagcagatgggaaaagaccctggaagatttaaagcggtaatatcgatagcctgacgccatgcgtcaggctttttttatataatgaaaacaaaagggggcgtgagaaatggaacgtgcggggatcagtcactcggacggctttgatttagcttatcgaattgagggcgagggcgcacccatccttgtgatcgggagtgcggtttactatccgcgccttttttcctcagatatcaaacagaaatatcaatgggtctttgtcgaccataggggatttgctaagcctaagcgggagcttcgtgcggaggattcgaggcttgatgccgtcttggctgatatcgaaaggatgagaacatttcttcagcttgaggatgttactatcctgggacattccgggcacgcttttatggctttagagtatgccaggacatatcccaaacaagttcggaaggtggcgctctttaatactgcgcctgataacagtgaagaaagacagcgaaaaagcgaatcatttttcatggaaacagccagccttgagagaaagaaacgatttgaaaaagacatcgcgaatttgccgcaggacatcgacaaagatcctgaaaggcgcttcgtgcacatgtgtattcgcgctgaagcgaaaagcttttatcaagagcggccgcatgctgctgccttatgggacggtgtattcacgaatatgccgatcattgatgaattatggggcaatacatttgcccggattgatcttattcagcggttagctgatgttcgtatgccggtgtatattggattagggagatatgattatttggttgcgcccgttgcgctatgggatgcagttgacggtttatatccccatgtggataaggttatttttgaaaggagcggccatcagccgatgctggaagaaccggaagcctttgatcaaagcttcagcaaatggctggatcaataaaaaaacagcccgcagatcaaaatccgcgggctgtttctgattataagacccctttcatcgcgcgtttgataaccggcgagagcagcaggagaatgccgccaagaacgatagaaatcaaaccgatggtgccgaagtacattgtttcaggaattttatcaaacaatccggctacttgggcattgatcgcttgtgctgctgcgttcgtcagaaaccacatactcattgtctgtgcagagaaggcagctggtgccagtttcgttgtcacggataaaccgactggagacaggcacagctctccaagcacgacaagcaggaagctgagaacgagccaaagcgggcttacgagtgcttcttttccttgcatagcagggaataccataatgataaatgacaatccggctaaaataattccgattgagaatttaactggtgtagacggctggcgtttgccaagcttcatccagagccatgcgaatattggcgcaaaaatgacgacaaacaatggatttaatgattggaaccatgatgactgaagttcgaatccgcccaatgaaagtcttatgcgttcatcagcgtataccgcaagaatggtcgctccctgttcctgaatggcccagaacatgacagcaccgataaacaaaggaacgtaagcggcaagacgggatttttctgttttgtccgcttttttgcttgtaaacatgatgatgaaataaatcacaggaatcaaaataccgagaatacttacaaggtcgataaaacgattgatcgtcagcacgcctgtttgtacagagataatcactgcgatcgccacgatgataacaccgattccggtgccaatcgcagattttttagacagcggattcggcacattggaacctgcaagcccgaggtttttctttcttgtcaaagcaaaaacgataagtccgagaagcattccgaccgcggcagctccgaagccgagatgatagttgtacttctgtccgagtgttccgacaattaacggcgcaagtaaaccaccgaggttaatccccatgtagaaaatactgaaacctgagtcgcggcgcgggtcttctttcgtgtaaagatccccaaccacgcttgaaacgtttggttttaataagcctgttccgacaatgataagcaccatgctgatatagaatgcgatcgcgctgcccggataggcgagtgcaatgtggccgaacataatgaatatgccgccgtaaaacacggtgtttgcggtaccgaatacccggtcagcgagccatccgccaataatggtggacatgtatacgagtgatccgtaaatcgacataatggcaaccgcagtgcccttgtcaaagccgagccctccgtttaccgtctctgtatacaaatagtaaagtaagattgctctcattccatagtaagagaaacgctcccaaaattcggtgaaaaatagtgtaaatagtcctcgcgggtgaccaaagaaccctttttgcgggacgcttttaatgatactttcgttatcaatcgaagccatgtcagccaaaccctttctaaaaaaagtgtattataaaaatcatattcttatataatacttgtgtcaatataatttatactcatttcaaatagttccatattggaaaaattataaatacctaaaaatagtgatttcctcctaatttttaaactttttatcgtgagattttcttacacaactattcctttatatttttttaataaaattttagagaaatgtacaagcagatcgggcctttgtgagtaacatgatagtaatcatagagaaggaggctcgcaattggctgaattcatattaaatgcagcggatttcggtgttcctggagatggtaaaacggattcgacagaacggattaatcagtgcctcagtacagctgtatcgaaaggctatcatactgtctggtttccaaagggaacatatttaatagacgcaacgcttggcggagatcttaatcagaggtttcgaaacgcggggatcattgttcccggcaaccttgagattatgatggaccccgaatgtatcatgaaagtgatcccgaatagttcgtggggttattccgcattttatgtgggcaagcaagagaatataaccatttccgggggacaaattatcggcgaacgggatgagcatacgtatgcctcggcagggataaggtcaacccatgaatggggctttggcatatgtattgaaggatgctcgaatgttgtcattgatgatgtgaaaatttctgattttaccggcgatgggatcatagtcagcccaaggggattaaagaccaatcaagattatcgaacgtcagagcaaattatcatccgccgctgtgaggttcggcggtcgaggagaaataacatttccattaccggatgtgacatggtcacggtggaggaatgcttgattgaagatgccggaacggggaatggaacagcgccgaaattcggaattgacattgaaggatatggcgaaggtgatgttgattatgaggaaccgattaatgtatcaattcgcaataaccactttgttggaaacgtttcaagttctgtgaccaattttaacgggtatggcattttaatagaaggaaatcactctgacaatacaatcagctacggatatgggacgcaaacagtgatcaagggcaatattctgagacgccctgaagacgcggcggctgcgccaagagtcgggataaccggactcggtgtatcacaaggaaaagagaccagtgatgcagtgatcgctggcaacctcattaccggattttcaactggaattgatgtcagaggaaagagcgttcttgtgacgaacaacaaaatcagcaactttgaaaacacagggatattggtttatcagtcttccgatgtaaaggtagacggaaaccaaattcaaaacggactgtctgaaacaaggcgcagcatcggtcttcgcgcagtgctgtcagatgacatcgcttttctgaataactgtctcattcaagtcgttgacggtgtgaacgtttccggcggaaatatgatcattaaagataatctcctgagaaaattcagccggggcatttggattgctcaagggaacgcggtgattgaagggaatacactgaatcctgacgcgtttgaagcagtgccggaatcatattctgtttccgtcacaaacaatgccggcgccatcatcaaaaacaatacatttaaagagttcaaaaattaccccatttattgctccacaagtgcaaaaacctcaattatcggcaaccacttagagcgatccccgcttttggtcaccatctatatcagcgcaggtgtgcatgagatttttgataataccatttcagtcaacagaacagccgggaatccgattgtgatttatctcaatggctctgcaggctctatcatctctggaaacaccatcaataacctctccgcgggcactgcgacagctattcaaacaaacacgtcaaccaattccaaaatcatcggcaaccgcatttttaaagggaccatcaacaaacacagcagtgatacaatagacggcaatatgattgtctgaaaaaagcgcccccctttaggggttcttttttttcgatttatagatcacgtacatttctctcacaagtactaacacaaaaaataaaagcacgacccattccgcaaatgttgtcatcttaaagctggacatattgttataaacggcttttgttaaactgaacccttgaagcatgtccatcaacacagaaatagctaataaacaaattaatatgactccggtcacgcccaatatcttcatgcttcatcatcctccgcttttagtgtctatctttggcggagaagttataccgcatctaaccctaatgcataatctcaattttaaaaggaagaatatgagaaaacgacaaggaaaggtatttgtgtatgcctttattttctaagcgaaagaacaataccgattcaaaagacaagcagaatacagacgaaaggaatcaggaacagcagcaagaaaaagaaaggccggttctcatttctccaagtttggcaaagaatatagcggaaacgaaaaaggaagtcggaagcagctctgacgtcatcattcgcgagattaaaatcggggagcaggatcatgtccacctagctgttatctatattgctgggctggtcgataataacacgatccatgagtcgttaattgacccattggtacaggatgagtctatccagaatactcatgcgatccagcaaattcttgaaaaaacgctcccgctgggcggggtgaaagcggaaaagagctgggacaagcttttttccgagttaatgctcggcaatgcgctcatttttgctgatggccatgatgaagctttgatttgcagcactcaagggggagagcagcgctccatccaagagccgagcacccaggtgtcattccgcggcccgcgccaagggtttacagagtctctgcaaaccaatatttccatgatccggcgatacattaaaaatccgaatttatgggttgaaaaaatgaaaaaaggttctgttacgaatacggatatcgctctcatgtacattcaaggaatatgcgatgaaaaggtgctgaaagaagtgaagcagcgcctggaaaaaatagatattgacagtattttggaatctggatatattgagcagctgattgaagatgaaacctttacgacgtttccgactatgtatcatacagaacgccctgatgttgtagcgggtaatctgttagaaggaagattcgcgattattgtggacggaacaccgtttgtgcttattgccccggccttatttgtccagttttttcagtctgttgaggattattattcgcgttttgacattgcgacaagcataagaattcttcgtgttttagtctttttcatttcgcttgtggctccggctgtatacgtggcagccacgacgtttcatcaagaaatgataccgactcagctgttagtggtcattgcggcccagcgggaaattgtcccgtttccggctgttgtggaggcgctgacgatggaggttgcttttgagattctgagggaagcgggagtcaggctgccccgggttgtcggctcggcagtgtcaatcgttggcgcgctcgtaatcggccaggctgccgtacaggctggtatcgtctctccggcaatggtgattatcgtggcactcaccgcgattgcgagcttcgcaacaccggcgtttgcaatggcgatttcagcccggcttattcggtttatctttattattgcctcagctgttatgggtttttacgggctgattttagggatcattatgatgtttgtccacttatgcagtcttcgttcattcggcgttccatatatgtcgccgcttgcacccttttcttcacaaggcgtaaaggacgcgcttttccgggttccgtggtgggccgatgaaaaaaggccggaatcggtcagcaaggaagataaggtgcggcaggggcaagatcaacgcccagagccggccgcttcacgaggaatggtgaacaaagatttggaagaaggggatcagaatggtacgtaaatgtctattagccgttctcatgcttttgagcgtcattgtgctgcccggctgctgggataagcgggagctgacggatcttgcgattatctcggcgattggcatcgatcggacaaacgacagcaactacgtgctgcatcttcaaattatcaatccaggaaatgttgccggcggccttcagggaggcggtgctggagacaggccgcctgtatctgtctattcaattgaaggcgacaatttgacggaagcactcagaaaagcctccatgaaggtatcgcggcggctttattttgcccataccaacctggtcgtaatcagcgaaaagctggcgaaagaggaagggctggattttgtattagacaatcttgaccgggacacggaattcaggacaacggcgaccttcgtcgttgcccataaaacaaaagcagaaaatatcgtgaaaatcctgacgcctattgataaaattccgtcaaacaaagtcaataaaaccctcgatttcacggaggcgcaatacggtcgggtggtcaaaaccaatattcaggacgttttgaaaacacttgccagcgacacaagggcaccgattattccgggttatttgatgattggcgatgataaaaaaggagtcagcatggaaaacacgcaggcaactgacccgaaagccattcttcaggcagacggattggcgatttttgacaaggctgggtatttaaagtattggattgaagatgatgaaagcgtgggggcagtctggcttatgaataaggtccagcatacgtttattaatgctgattggggcaagacgaaggatgcggtcagcttgcaggttacccatcaagatacaaagctggtacctgatatgcggaacggacgtccgcacatccatgtgaaagtgacggttgaaggaattatagatgctgtcaaataccctttccaattgtctaatccgaaggtgctggccgctattgaaaaagcgctcaacaaagagcttgaaaaggaaatcagccatactgtgaaaaagatcaagaagaataagatagattttgtcggttttggtgacacgatatatagaaagtatccggagcagtgggagaaaatgaaggacacttgggacaaagaatatttgccggaactgcccatcgatgtgaaggccgagacgtatatcagaaggacgggattgcgaaacaatccgatcaaacaccagtttaaagatgattaggtctgaagaaaggggaagtgacagatggaaaaagccagaataagcataaggcagctgtttgtcatgattatcatttttgaactgggcagctccttattgattacaccgggatcaatggcgggcagggatgcttggatcgcagttctgttggggtgtgcggccggtttgtttcttttctatttgtatcaaggaatttatcaatgttaccccaattcttctccgaaagaatatatggatgatatgctgggaaccaagctgagctggctgttttcatttctctatatcttgtactttgcctatattgccgcaagggtcctgcgtgactttggagaaatgctgctgacatttgcttatcatgatacacctatcattattgtaaatggtttattagtgatagtaagcatatacgctgtaagaaaaggaatcgaagtgctcgcccgcgcggctgagctacttttcggagccatgtatttactgggcgcgatcggcctcgtgctgattgttgtctcaggttctatagacccgcataacttaaaaccggttttggcaaacggtatctctcctgtcctttactcagttttcactcagaccatgtacgttccgtttggcgaagtcgttttatttgtgatgattttccctaacctgaatgacagaaaagatgtgaaaaaaatggggatgattgccatagctattagcggattggttgtggcgctcaccgtggcgattaatatcagcgtgcttgatgttgatcttacactcagatcccagttcccgcttttaagtacgattcagacaatcaaggtcgaagaatttttagaccggctcgatgtcttttttatgctggcgctgatcatcggcggcttctttaaggttagcctctacttatatgccactgtggttgggacatctacgctctttaaggaaaagaacccctctcaattggcttatccgatgggattgggcatcttaatcctttctataacgatcgcgactaacttttcagagcacttgaacgaaggcttgaaagtggtgccgctgtatattcatttgccttttcaattattgtttccgctctttctgtttattgtggctgtttggaaaaagaaacgaagagagaagtcaaaagggacaggagcaaaaaaatgataaaaagagcggggggatgcagccgccgctctttttatgttcacttctatataaaagggggatatagggtgcgcccctgtctgcactggcagaggcgcgttttgttatacgactgcgacgttttccttcacagtaaagcttcctcttgaaagtctgatattgatgtctgacacttttgcaatttgttcatcgtgcgtcaccataatgacgcatttatcttccttgtgcgccagatcctgaaagagccgtacgatctcttttgatgtgtcctcatcaaggtttccggtcggttcatcggctacgataagatccgtgtcacagcagaaagcccttgtaattgatacccgctgctgttgtccgccgctcagtgtgagtactttttgccgggcttgtttttcgttgatgccaaccttctgcagcatgtcaagcgcatatgattcgttgttcttttctttagaacctgtgatttccatagcggttgtgacgttctgcaaagccgtcatatacgggagcaggttgtacgcctgaaagacgattgatacatattgatttctgaaattggttaagccgattttagaaaccgcttttccgccgtaaaggatgtttccttcttttggtgcgtcaagtccgcctgccagagacaggaaagtggttttccccgtccctgatgtgccgacgattgtgtagaatttgcctttttgaaagccgatgttaatatcctgaaacaatggctggcttttgtctttataccagtagccgacttgttgaaattctaataagctcataggttccgcctctttctattcctgttttgtcaatatcgttttcggatgaagccgcagtactgaaattgacggcagcaatgttgcaatgattgcgattaggatgccgatcccgccaagaataagcatgtcgttcatagaaaccgcgacgttcagtgaatcgataacgtccacgtttgatgaactgtggccgaacattttgccgcccatgccgccgccgggcatttgtccgcttgcggtttgcgttgaatcggttgatgaactgatttgctgggataaaagctgatttccaagctgatttgcgacgagatttcccgtcacagatgcaaggccgatagcgataacggccacaatcagaatctcagtcaagaactgtccaatcaatttccatcgtttttcaccgatggccattaacacgcccatttcgtatttgcgctccctgattgacatcatgacaatcaggccaagaatgacggcgcctgccactgatacaagatacaccacgtttttagagaaagaagccacattttcaatcggtccgaccatttgctggtaaagctgatcgtttgtattcagtgtgtacgtatcgaagtcaattgatgttttcttcgctgcttttacgaaagcatccatatttttcgcgtcgtccatatagtaaacagctgagtcaatcgtatttttatagtcgtcgcctttcagcgccgctgttgctgtgtaaggcgtataaagcttgttataaggatttaagaaagagaaattttgggcttggtcatcaccagaagatgttgttttataaataccgacaatcttcagctttaccgtcgtatcttcatctgttgctgattcaattgtgatcgaatcgccaacgctcaaatcattttcttccgctaatgtttcgttgatcactgttacttttttgccgacatctgattttgtaatcgcgcgtccgtcagtgatttttgaatccccgtcagagaaatcatcaactaatgctgtgctgatgacaccttcaatcgaaagatcagcttgaaccatttgcggtccgccttgtcctccgccttgactgtttttagcgtttgagcttgaactgctggagctggaatcacttgaactagagctttcaatcgcatcaaagtttcccgcgttggctgaagctgatgtggtgtaattgtagctcttcacatgatcaagcgctgcaagcttattcgcatcagacactttgatcggtgtggattcgaagctgcgcttttcaccgctgtcctgctgtttttccatttgcttttggcggtcaacctgaagtgtcacgcttccgccgagttcctgtctggccagttcgcttgatttttgtgctgccgactggatggtaaggcctgatagaacaaagacacatatgactgtaaacacaaataattgcaataacgtttttccctttttagccttcatattccaaaaggcccgtttgataaagttcatttatgttcctccgtataggtttttttatggataagaccgcctctggggcgcgcccgctgataaattaatagtagtccaaaggtatgaaaaaaatatgaacaatctatttctagttgatgaaataaaaactaacaattgtgaaacgcaaaaccttctgtttaaaatggtgctattatataaaaaagcatcaaaacaaccggaggatataatgaaaatattaatgatagaagataatgttagtgtatgtacgatgacggagatgttcttttttaaagaaggttttgaagcggaattcgttcatgacgggttagaagggtaccagcgttttacggaagaaaattgggatctgatcattttggatatcatgcttccatctatggacggcgtgaccatctgcagaaaaataagagagacaagcacggtgccgattatcatgctgactgccaaagacactgaatcagatcaggtcatcggttttgagatgggggcggacgattatgtcacaaagccgttcagcccgctgacattggttgcccgcatcaaagccgtcatcagaagatataaggcgacaggcaaagcggttattgatgaagatatgattgaaacggaatgctttaccattaataagaagacgagagaagtattattaaacggagagcctgtagaaaatctcacgccgaaggaattcgatctgctttattaccttgtccaaaatccgcggcaggtgttctccagagaacagctgcttgagcaggtatggggctatcaattttatggagatgagcgaacggttgacgttcatatcaaacggctgcggaaaaagcttgccagcgaggacaagcctttcctgtatactgtgtggggagtagggtataaatttgatgaagattaaatatttatatcagctgctgctaagccatatcagcattttgattttagcgtttgtcattatcatttctctgttttcccactttgtgaaggaatttgcctatcagaacaaagtagaggaattgacgtcatatgcggtgcagattgcaaatgaattccaagccggccaggtggacatgcgcaggctctatccttatcaggacatgttaagcacaagaaagacgcagtttatcatctttaatgaagagcagcagccctattttcttcctgaaggctttcatcacccaccaagggaacagctgaagaagtcagaatggaataagctaaaaaaagggcagactgtcatgatcagggcagatggccgttttgatgatgaagtgtcacttgtggcgcagcctatatttgttcagaacgaatttaaaggcgccgttctgctgatttctccgatcagcggtgttgaacagatggtcaatcaggtcaacctctatatgttttatgctgtgatcagcacgcttgtgattacgattctcgtgagttggcttctgtccaaattccatgtcaagcggattcaaaagctgagagaagcgacagataaagtggcttccggcgattatgacatccatttggaaaacagctacggggacgaaatcggcgttctggcgtctgactttaatatcatggcgaaaaaactaaagcagtcaagggatgaaatcgatcgccttgagaagcggagaaggcagtttatcgctgacgtgtcacatgaattaaaaacaccgctgacgacgatcaacggtttggttgaagggttgaacagccatacgattcctgaggataagaaggataaatgcttctcgctgatcagtgaggaaacgaagcgcatgctgcggctcgtaaaagaaaatctggattatgaaaaaatcagatcccagcaaattacattgaacaagctagacgttcctctgatcgaggtgtttgaaatcgtgaaagagcacttgcagcagcaggcggaagaaaaacaaaacaagctgatgatccaagtagaggatcacgtcatcgtacatgccgattatgaccggttcattcaaattctcgtcaacattacgaaaaacagcatccaatttacgaaaaacggtgacatttggctgcgcggaatggaaggttataaagagacgattattgaaattgaagacacgggtatcggcattccaaaagaggatattgagcatatttgggagcgattctataaagcagatatttcaagaacgaacacggcatacggtgaatacggactcggtctctcgatcgtcaggcagctcgttgaaatgcaccagggcacagtagaaatccagagtgaagaagggaaaggcacaaagttcataatccgccttcctttaacggcaaaacagcaatagcatacagggcggcgcatcaattgatgcagccgccttttttgcacaccgcttcggtttattgcgtgctcccgaaaacaaagattgcgtgtttttcgggttgggacggtctataaacatgataaaatatgacataaacagtttttgatgggagagggtgaaggaatgaagagcggggtaattccttcttcagcggtcggtcaaaaaattaacgagtggtacagatatatccggacattcagcgtgccggatgccgaagtgttaaaagctgaaatccagcaggaactgaaacacatgcagcatgattccaacttgctgctttattattcactaatggaattccggcaccagcttatgctggattatcttgagccgttagagaaattaaatatcgaagaccagccaagcctgtctgaattatcaagaaacattgacagcaatcaggcagatctcaaagggctgctcgactattacgtgaatttttttcgcgggatgtatgagtttgataagcgggaatttatttctgccattacatactataaacaggcggagaaaaagctctcctttgtcgcagaccatattgaacgggctgaattctattttaaaatcgcggaagcttattattatatgaagcaaacgtatttttcattgattaatataaaaaacgcctatgaaatttacgtggagcaggaaacctataatgtgagaatcattcagtgccatttcgtgttcggggtcaacctgatggatgaaagaaatttcgaacaagccgcacgccatttcaaattggcgctcaatatggcccaagcggaacaaaaagcccagctggtcggaagagcatactacaatctcggattatgctattacaatcaagaccttctaggccctgccattgattactttgaaaaagcggtctccacgtttgaaagcagcaggatcgtcaattctctcccgcaagcctattttttaatcaccctgatttattataaacagggaaaacatgataaagcttcggaatatcacaagcggggctatgaatatgctaaagaaacagacgatgcagactatgccgtaaaattcgagtttttgcaatccctatatcaggatcagcccaatgaagaaggaatcgaacgatgtttccaatacttaaaaaataaaaatatgtacgctgatatagaggatttagccctagaagtagcaaaatattactatgaacagaaatggtttaaactgtctgcttcctactttctacaagttgaagaggcaagaaaacaaatacaaaggagtgaaggtttgtatgaaattgaaatctaagttgtttgttatttgtttggccgcagccgcgatttttacagcggctggcgtttctgctaatgcggaagcactcgactttcatgtgacagaaagaggaatgacgtaagaacaagccccttctcattagcgagaaggggtttttcttttcaaaaaaacaccgcaagacatagtcttgcggtgccgccttcatggagattacgtttatttagtagcctcctacaaatgcagttcccacaatgatcaagaggataaataacacaacaatcaaagcgaaagaagttccgtaacctgacattttgtgcacctccttgcgagattgcttcagcaaatgctgcaaaactgtggcggacagggtcccgcagagacggtcagcagcttagaagccgccaacaaacgcagtccctacgataattaatagaataaacaatacaacgattaaagcgaaagaactgatgccgccgtaaccgccgccgttagagtatcctgacataaggtttcacctccctatgaaggatactataagatatgctgaaccgatccatttggcagggataatagtggacaagagaaaaaatgaagaattcggctatatgaaggtgatataaaaaaatagcgggcgctgccgcccgctatttatgtacgattaagagatcagcacgcccgcgaaaaattcctggtataacgcttgaacggcttttctttcttcggcttcttttacgccaaacatcatgctcacttcagaagacccctgattgatcatttcgatattcacctgtgcctctgataatgctttggcggctcttgccgttgtaccgacattgtggcgcatcgcttcccctacaaccataatcagggcgagatgatgctcgacgatgacttcatcggcatgcaaatcctcttcgatccgtttgatgacgctgcgttcagtggcggcatccatttgcccctgccgtaaaatgattgtcatgtcatcgattcccgatggaacatgctcatacgtcaaaccatgctcctccaggatttgaagggctctgcggccaaaaccgatttctctgttcatgagatacttgctgatataaatgctgcaaaaaccggtgtcgctggcaatgccgacgacaggcccgtttgtgttatcccgcttgctgacgacgcgggtgccttcggctgaggggttgttcgtatttttgatctgaacaggaatccccgctctgaatgccggaatgagcgcttcatcatgaaacactgaaaagcccgcgtaggacagctcccgcatctctctatatgtcagctcgctgatttcctttggattctcaacgaaggacggattgacagaatacacagcgtctacgtctgtaaagttttcgtacaaatcggcttgtagtccgttggcaagaatcgaaccggtaatatcagaaccgctccgtgagaatgtgatcacatcgccatccttgctgaatccgaaaaaaccgggaaaaatgatgagtccgtcacgttcccgaagacgatagaggttttgataggattcaggaagaacttgcgcgttgccgggttcatttgtcacaaagaggccggcatccttcgggtttacatatttcgctttgacgcctttataacggaagtaagcggcgatcagtttggcattgttatcctctccgctggccttgactgcgtcaaggtattgttcgggattgcttttgtctccttctaaaagcgtaaacagatcatctctgattttttcgataatgctttgccccagctgaagctcattggcgatgagagcgtaccgttccacaacagcttccgccagttcaggtgcgctgcctgttgccaaatattgttctgcacatgcgattaagagatcagtcactttcgtatcctcggcatagcgttttcccggagctgaaacgactacagctttccgtgccggatctgaggtaacgatgtgaaacaccttgtcaagctgggcgcctgaagcaagtgagctgcctccgaatttaacgaccttcatgtttacatctcctaatgtttaaaattttcacacaaatttagtatttattatctctctttcagtactgtaaatcaaggggggatttctttctcaggagaacatttgtatttttcacgaggaataatgttaggtttgctgaccgtatgcctgcgttataaagataaatatggtaaacagcctaacgttttgggatggaaaatggttagaatgattagtaaaattgataaatgactaggttaatatttttaaagaatattgactaaccctataaaaatggtaatatgtaaatgataatgataatcaattactatatggccatattgttttgagtccttgcggagtaggagatacgttctttttgctgtaaggatgtaaggaggcagcatgaagctacgttacttatttattctacttatcatattagcagtcacatctgtatttatcggtgtagaagatctgtcgccgcttgatctcttcgatttaagcaaacaagaggcgtcaacgctgtttgcaagccgtttgccgcgattgatcagcattgtcattgcgggattaagcatgagcatctgcggtttgattatgcagcagatcagcagaaataaattcgtgtcaccgacgacggcgggcacgatggattgggcgaggctcggcattttaatttccttgctgctgtttacatccgccagtcctttaatcaaaatgctggtcgcgtttgtctttgcccttgcaggaaattttctgtttatgaaaatccttgaaagaatcaagtttaacgacaccatctttattccgcttgtcggtttaatgctcgggaatatcgtcagttcaatcgcgacatttatcgcatataaatatgacttgatccagaatgtgtcatcatggctgcagggagacttctctttagtcgtgaaaggaagatacgagcttctttatctgagtattccgctcgtcatcattgcctatgtgtatgcggataaattcacattggccggtatgggtgaaagcttttctgtcaacctcggcctcaagtataaacgggttgtgaacatcgggctcattatcgtgtccctgatcacgtctcttgtcattttgactgtcggtatgctgccgtttctcggtttaatcatcccgaatattgtatcgatttacagaggagacaatctgaagagcagcctgccgcatactgcgctgttgggagcagtttttgtgctgttttgcgatatactgggcagaatcattatcttcccttatgaaatctcgattggcctgatggtcggaatcatcggcagcggcattttcctgtttatgctgttaaggagaaaagcctatgcgtaaccagatgaaaatagctttgctcgttggtttagccattgtatgtattggcttgtttttgttttatgacttaggcaattgggattacaccctgccgagacgaatcaaaaaagtcgctgccattgtgctgactgggggagcgattgcgttttcgaccatgatctttcaaacgattacgaacaaccgcatcctgacgccgagcattttgggccttgattctctctacatgctgattcagactggcattatctttttgttcggttctgcgaatatggtcatcatgaataaaaacatcaactttatcatctctgttctgctgatgatactgttttctcttgttttgtatcagatcatgttcaagggtgaggggagaaatatctttttccttctgcttatcggaatcgtgtttggcacgctgttcagcagcctgtcttcttttatgcagatgctgattgatccgaacgagttccaagttgtgcaggacaagatgtttgccagctttaacaatatcaatacggatttgttatggctcgcgttcatcatcttcctgctgacaggcgtttatgtctggcgttttacaaaatttttcgatgtgctgtcgctcggacgcgagcacgccgtgaatttgggcattgactacgacaaagtggtgaagcagatgctgatcgtggttgcgattttggtttctgtttcaacagcgctagtcgggccgattatgtttttaggccttctggtcgtcaacctggcgagagaattcctgaaaacatataagcattcatacttaatcgcaggctccgttttcatcagcatcattgcgctggtcggagggcagtttgtggttgagaaagtgtttaccttctcaacgacgctgagcgtcattattaattttgccggcgggatttattttatctacttgctgttaaaggagaataaatcatggtagaggtcagaaatgtaagcaaacaatatggcgggaaagttgttcttgaagagacgtcagtcacgattcaaaagggcaaaatcacctcgtttatcggtcctaacggcgccggcaaaagtacgctgctgtctatcatgagccgcctgatcaaaaaggattccggcgagatttacatagacggacaagagattggagcatgtgacagcaaagagcttgccaagaaaatgagcattttgaagcaggcgaaccaaatcaatatcaggctcacgatcaaagacctcgtcagttttggcaggtttccgtactcacagggccggctgacagaggaagactgggttcatatcaaccaggcgcttagctatatgaagctggaagacattcaagacaaatacttggatcagctgagcggcggacagtgccaaagggcatttatcgccatggtcattgcccaggacacagattatatctttctggatgaaccgctgaacaatctggatatgaaacactcagttgaaattatgaaactgctgaaacggctggtagaggagcttggaaaaacgatcgtgatcgtcattcacgatatcaattttgcttcagtctattctgactatatcgtcgctttgaaaaacggccgaatcgttaaagaaggaccgcctgaagaaatgatagaaacatcagtgcttgaggaaatctacgatatgaccatcccgattcagacgattgataatcaaagaataggtgtttatttttcttaatatatagaagaggtgaggagcatgaaaaagttcgcgttactattcatcgctttggtcactgccgttgtcatttctgcatgcggaaaccaaagcacaagcagcaaaggttctgatacaaagaaagaacaaatcacagtgaaacaccagctcgacaaaaacggcacaaaagtaccgaagaaccctaaaaaagttgtcgtatttgactttggaagcttagatacattagataaactaggacttgatgatatagtagcgggcctgccgaaacaagtccttcctaaatatctgtccaaattcaaggatgacaaatacgctgatgtcggcagcttaaaagagccagacttcgacaaagtggcagaattagatcctgatctgatcattatttcagcaagacaatctgagtcttacaaagaattctctaaaattgcgccgacgatttaccttggtgtagatacagcgaagtacatggaatcatttaaatcagacgctgaaacaatcggtaaaatctttgataaagaagacaaagtgaaagatgagctcgcaaacattgatcactcaatcgcagatgtaaagaaaaccgctgaaaagcttaacaaaaacggtctcgtcatcatggcgaacgatggaaaaatcagcgcgttcggccctaaatcaagatacggcctgatccatgacgtgttcggcgtgacaccggctgataaaaacatcaaagcgtctactcacggacaaagcgtttcttacgagtacatttcaaaaacaaacccggattacctgtttgtcattgaccgcggtacagcgatcggtgaaacatcatctactaaacaagtcgttgaaaatgattatgtgaagaatgtaaacgcagtgaaaaatgatcatgtcgtctaccttgattctgctacttggtacttatcaggaggcggtcttgagtctatggcacaaatgatcaaagaagtgaaagacggtttagaaaagtaaaaccaaaaagagcctccgctaaatagcggggctctttttttgttaatcagcgtgccggctgctgttcggcagggcgctgaggtttctttaatgtgaatgagagaaggaagccgacaagtgcaatgacggcagccactataaaagcggcgttcatgccgtgcagggcggcgtgcttcacatttgtcgtgcctgcatgtgccgcctggttgctcatcacggaaaccaatagtgcggttccgatcgagccgccgacttggcgaatcgtgttgttcatcgcagttccgtgcggaatcaagtggcgcggcagcgcattgattccggctgttgtcaccggcatcatgatcatggcggtgcctaagagacgaacggtgtataaaacgacaatccaagcgagtgacgtatggtcagtcagctgcataaacggcagagatgtcaggaagatgatgcagaaaccggcaatcgccagccctcttccgccgacacggtcaaaaattctgccgataatcggcgacataaagcccatcacaacggctcccggaaggagcataagccctgtatcaaaagctgtgacgtctctgacattttgtgtataaagcggcaggatggtttccgtaccgatcaataatgcaaagacgagggttcccagcagtgttgttaaactgaaaatgccaaacgtgaagacgcggaattccagcatcggtttttcaagcttcatttgtcttgtgataaacaagagcagcgcgatgacacccaccagcagtgaaatcaagacggttgaactggaccagccgtaagagccgacgcttgagaagccgtacagaaggccgccgaacccaaatgttgaaaggatgactgataaaatatcaatctgtgtttttcttaaagtcgtcacgtttttcatcaggatgctggcaagaatcaaatcaatcacagcaaacggaagaataatataaaacaatgatctccaagagaaagcttcgacagcccatccggaaagagtcggtccgatcgcaggcgcgaatgagatgaccaatccgaccatacccatagcctggccgcgtttttcaatcggaaagattgtcaggaatacagtctgcatgagcggcatcataatgccggctccggccgcttgaatgatacgcgctgtcagcagaaccgggaagttcggcgcgaacgctccgacgactgttccggcagtgaaaatgctcattgctgtgatgagcagcgcccggcttgtgaatttctcaattaaaaacgcggtaatcggaattaaaatcccgttggttaacataaatgatgtggtcagccattgtgcttggttggcatcgacattgaaatccctcatgatatggggaagtgcggtaatcaacaatgtctggttcaaaatcgccacaaacgctccggctaacaaaatgccgacaatgacagaacggttaaaaggtttttgttcaatacttgtgttcaatacatatcccttcttttctctaagtaattaacagtgtttttaacatggaaacgggctgtgttaaaacactggtttgttccagatagccaatcagtgatttgagtaaaaaagcgcggggttcttccttcttcgcttcttcctccagcatggcggctgcggatgtcagttcatctacgtcatagtccgcggcggacagggaagagatgcctttatgtaattccttcaggctttccgataataggactgatttatcctttggcttgtaggaggatgctgaatgaatataaagctcgatggcttcgggcggaagaagagactggcgggtttccctgtttttgataatctgattgagggtgctgatgataaactctgcgatcgggtcaagctcaagcggtttttcctcgattttgatcagcattaaaaactcacgcatcatgccgtgaagaatgataaccaaatcccacacaaacgggagaatggtttctccatacgcctggatcagcgaatcgcggtgccagcagataatcgtcgatctggtctgatggatatgctgtttgacccggtcattatgcagcttggggtttccgtaggtcagcatattgaaaaactgctgattccgcctgaagccctccagttccattttgaccttttgcgtcaaacgctcctccggtgtaagtgcggtattttcctgaagtcttgaggctgcggccaccatttgcttctggttaaatgacagcagctccaaaagcagatcttctttagattggaacagcttatatatcgaagcttttgacatcttacattcttctgcgatcgcctgcatggaaaccgacgtaaaatccttttccgaaaaaagctttcgcgcggctaacaagatatctgtttttttatcaagcatctcatggcttccttctttcttgaacattagaaaacccattggttcacagaaaaccaatgagtaactatgaaaaaattttaccaaataaacaaaatagaagtcaatggattttaaccgggtaaatgaaaggcctgccggaaaatccgacaggccgaataagagcttatttttcaactttaaatccttgtttttcaagcatttcacggatgtgcggatagtacaggcgctcatagtaggaagcgatgctctgtgaccaatttcttgtttcttttccgtttgtccgtttattcatgtattcagacatctgttcgtcgtatgcctgaatgtgagacgtcagctcatcctgattcaaataagtttcctgatgattgacagcttcctgcggcaagcgcggttttttcgctgaacggtcggcaggatgcccaatgacaaggccggataaagggaacacgtattttggaagctcaagcagttcgatcagctcttgagggtttccgcgaaccgcaccgatcggaactgtgccaagtccgagtgactcagccgctgctgttgctgtgccgagggcaataccagcgtctactgcgccgacaagaacagattccaatccatttgtgatttccattttgaaatcatgcagatcttcaagcgcaattttggcccgattgaaatctgcgcagaacagcaggaaaacaggagcttgatcgatccatggctggccgcctgccagctcggagattttctttttgcgctctttatcctggactgtgatcacagtcacctgctgtccgttgatagaagaaggggctgattgcaccgcttcaatgatttggtccaattgctcctgagctacaggctcatctgtgtagctgcgaatcgagcggtggtcttttaaagatttaatcacttcattcatatgggacaccctttctttactcgctaagctctgtgcggacaacatcaagaggggcgctcagcagttcttttccttttgcgacaaacccttggaaatgcgcagtttcgttatggaatttcattgccgcttcatctttccatttttcaagcatgacaaatgtattttcttcgcctactttttcgaataggtcgtattgcgcgttgccttcctcagctcttgaatgctgaacaagtgattgagcctcgctcaaaaattcctcgcgtttttctggttttactttgatgtaagcttgtaatacgatcatttaaatctcctccgttgttatgcgaatttattgttcgaatttcatcgaactaaatgtaacatgtattctaaatgaggtaaaggaaaaacccttatatagtaaaattgtcattctaattgttgtgtgatacatttgtgtcatgaacattccaaaccatccagaaacagaaacattgcagctgacaaaggttcttcatgcacttagtgatccgcttcgtttagagctcgtcaagcaattagctgaagcaaaagaaaaaacgtgcagcacctgtgcagatgtgcaggttgccaaatcgactttgtcgcatcattttaaagttttgagagaatcgggcatcgctcaagttcggatagaaggaaagcgccggtattattcgcttcgcgctgaagaccttgaaaaggcatttccgggcctgcttgaagccgtgctgaatgtagaccaggaccgctggtgaatcaatcccctgtaacggggatttttttatgtccgtaaaccgctttgaaaagccgctgcacacccgcctgaatatcttcttccttcagccgtgcaaagccgataatgagagcaggcctgcccgtttgccgcttgttttccttcaagttaaatcggctcattccgaatatttcaagctgcagcccggcagcatgtgacaggatgtcttgttcggtgcgcctggtatcaaattcggtaacaaaatgcagccccgcatttgccccttttacggtaacctctccgctgaactctgcttctaaagcggtgatcaggcgttctctcttttctttataatgctgcttcattttttttatatgcttctgatattcaccagactcgataaattcctgcagggtgagctgtgtgagtgatgagcaagtctgcagatcatagccccgctgtttgtatgccctcaacagctcaggcggcaacaccatatagctgatccgcaagccggggagaagggactttgaaaaggttcccatatagatgacattttgaaaacggtcgaggctttgcagcgccggaatactgtctacatcatatgtgaattcactatcataatcgtcctcaatgatatatcggcgcggctcctcggctgcccagttcagcagctgaattcttctggatacaggcataatcgttccggacggaaactgatgcgacggggtggtcaccagcacatctggctgctgtctggtgatttcagcaatcgacatgcctttttcatccagcatgatcgtctttacttgttttccggcattcttcaaaagctgatacatgcgcctgtagccaggctcctccatcgcatacacggcttccttgggtaaaagctcagtcaacagctgcatgagcacctgtgtgcctgcccctatgatcatttgttccggcctgcattttacacccctcgtcagggaaatgagcctcgtaatggccgctctcacttcatatatcccttgcggatgtgacatatcgccgagcgtgcggtatgagcgggaggccgctttttgctcgcagcggaaccagcttttgatcggaaaatggtctgtatcggaactcatgtgtgaaaacgatatccaatcgctctggtcgatgtgaatctcttttaggtcatccggcagtgcaaatggagggtgctcctcggcggaaaacatgtctagttcctccacgaagaaaccctttcgttcaatggcgtacaaatacccctcagccagcagctgctgataggctgaattcactgaatttacgctgaccttgagattttcagccagctcccgcttggagggaaccttcgagtgcggcagcagattgcggctgaggatttcttttttcagcttttgataaatttgctgatagatataatcggcttgttctgaacgatcgagtgtaatcgtgatatccatttgtattttctccttctgataccatcaaaaagttataattggtacttttcatcataccaaagagaagtcagaatgataagaaaataccgacagggggatattcacatgagtcaaacaacagcaagcatcacaactgcacaatggcagcaaaaacgggatcaatttgtgtcaaaaggtgtgagcaacggcaaccgcagtctggcggtcaaaggagaaggggccgagctgtacgatctggacggccggagatttattgattttgcaggcgccatcggcacgttaaatgtcggacactcgcatccgaaggtggttgaggctgtgaagcggcagacagaggagctgattcatcctggctttaatgtcatgatgtacccgacttatatcgagttagccgaaaaactgtgtggcattgcaccgggcagccatgagaaaaaagcgatttttcttaactcaggggcagaagcggtcgaaaacgctgtgaaaatcgccagaaagtatacaaagcgccaaggcgttgtctcgtttacacgcgggtttcacgggcgcacgaatatgacgatgagcatgacaagcaaggtaaaaccttataaattcggtttcgggccttttgcgccagaggtttatcaagcgccgttcccttattattatcagaagccggccggcatgagtgatgaaagctatgacgatatggtcattcaagcattcaatgatttctttatcgcttcagtggcgcctgaaacggtggcgtgtgtcgtgatggagccagtgcagggagaaggcgggtttattattccttcgaaacggttcgtacagcacgtcgcttcattctgcaaagaacacggcattgtttttgttgctgatgaaatccaaaccggctttgccagaactggcacttatttcgcaattgagcactttgatgtagtgcccgatctgatcacggtttctaaatcgcttgcggcaggcctgccattaagcggcgtgatcgggcgttcggaaatgcttgatgcggcagcgccaggggagctgggcggcacgtatgccggcagcccgctcggctgcgcggcggctttggcagtcttggatattatcgaagaagaaggactgaatgagcgatctgaagaaattggcaaaatcattgaagatagggcgtatgagtggaaaaaagaattcccgttcatcggtgacatccgcagactcggggcgatggccgcaatcgaaatcgtcaaggatccagacacgcgtgagcctgataaagcaaaagcagcagcgatcgcggcctatgcgaatcaaaacggattacttttgctgacagcgggaattaacggtaatatcatccgctttttgacaccgctcgtcatctcagacagccttttaaatgaagggctcagcatcttggaggcgggcctgcgagcttaatcattggaaagaaaacggctgggtctgctatcattttaagtaatcatgaaaagaaaggaatgttcaatatgccagatcaattaacggtctacaacccggctacgggcgaggagatcaaaacgattcctcagcaatcagccacagaggtagaagaagccattgaacgttcacatcaagcgtttaaaacgtggtctaaaacatcagcgaacgaaagagcgtctcttttgaaaaaatggtatgagctgattgttgaacataaagaagagcttgcagatttaattacaaaggaaaacggaaaaccataccaggaagcagtcggcgaggtactttacggcgcaggctatatcgaatggttcgcagaggaagcgaagcgtgtgtacggaagaacggtcccggccccgacaacgggtaaacgaattgttgtcacacgccagccggtcggccccgttgctgctatcacgccctggaatttcccgaatgcgatgattacacgcaaagcggcgcctgctcttgccgctggctgtacatttatcatcaagccggcgccggacacaccgctgtctgcttatgaactagcgcgcctcgcatatgaagcgggcattccgaaggatgttcttcaggttgtaatcggcgatggagaagaaatcggaaatgtgttcacaagcagtccgaaaatccgcaaaatcacgttcacaggctcaacacctgtagggaaaatccttatgaaaaacagcgcggacaccgtgaagcacgtctcaatggaactcggcggacacgccccgctgatcgtagatgaagatgcagacattgaccttgccgttgaacaggcgatggcgtccaaataccgaaacgccggccaaacctgcgtatgtgccaaccgcctgatcgttcatgaatccattaaagatgaatttgctgcgaaactgagcgagcaagtgtctaagctgaaagtcggaaatggacttgaggaaggcatcaatgtcggcccgatcatcaacaaacgaggcttcgaaaaaatcgtcagccaaatagatgatgcggttgaaaaaggcgcgaaggttattgctgggggcacatatgaccgaaacgatgacaaagggtgctactttgtgaatccgacagtgctcaccgatgtcgatacgtccatgaacatcatgcatgaggaaacattcggcccggtcgccccgatcgtcacgttttctgatattgatgaagcgattcagcttgccaacgatacaccgtatggcttggctgcttacttcttcacagaaaactaccgccgcggcatctatatttccgagaatttagagtatggcattatcggctggaatgacggcggaccgtcagcggttcaagcgccattcggcggaatgaaagaaagcggcatcggccgtgaaggcggttcggaaggtatcgagccgtaccttgaaacaaaatatttgtctatcggtttataaaagaatgcacgctcctgagagctgccggattttccggcagctctttttgtgttccggcgaataatcacaacaattccagccaaaataacagcaaatacattttgaaagaaggttccccaacaatggatttattattggctcttctcccggctttgttttgggggagcattgttctcttcaatgtgaaattaggcggcgggccgtacagccagacactgggaacgacgatcggggcactcattgtttctatcgttatttacttttttgttcagcccgttctgtcccttcgcatttttattgttggaatcgtatccggcttattttggtcacttggacaggccaaccagctgaaaagcattcaattgatgggcgtgtcgaaaacaatgccgatttccacaggaatgcagctcgtttccacctcgctgttcggtgtgatcgtgttccgcgaatggtcaacaccgattgcgattacgcttggcgttctcgctttgatctttatcattgtgggaatcattctcacgtccttggaagataagaatgataaaaaagagggcgagccaagcaatttgaaaaagggcattttgattctccttgtttcgactcttggttatttggtttatgtagtcgtggctagattattcaatgtgtccggctggtccgcgctgctgccacaggcaattggcatggtggtcggggggttagttttaacctatagacacaaaccctttaacaagtatgcgatcagaaatattctcccagggttaatctgggcaggcggaaatatgtttttgtttatttctcagccgcgagtcggcgttgcaacgagcttttccctttcacaaatgggaattgtcatttctacgctcggcggtattttcatcctgcgtgaaaagaaaacgaaacgccagctaatagcaattgcgatcgggattatcctgataattgccgccgccgtattcttaggaatcgccaaaacaaattcataacaaatggaggaggatgtatatgtatccggatttaaaaggaaaagtcgtcgctattacaggagctgcttcagggctcggaaaggcaatggccattcgcttcggcaaggagcaggcaaaagtggttatcaactattatagtaataaacaagatccaaacgaggtaaaagaagaggtcatcaaggcgggcggtgaagctgttgtcgtccaaggagatgtcacgaaagaggaagatgtaaaaaatatcgtgcaaacggcaatcaaggagttcggcacactcgatattatgattaataatgccggtcttgaaaatcctgtaccatctcacgaaatgccgcttaaggattgggataaagtcatcggcacgaacttaacgggtgcctttttaggaagccgtgaagcgattaaatatttcgtagaaaacgatatcaagggaaatgtcattaacatgtccagtgtgcacgaagtgattccttggccgttatttgtccactatgcggcaagtaaaggcgggataaagctgatgacagaaacattagcgttggaatacgcgccgaagggcattcgcgtcaataatattgggccaggtgcgatcaacacgccaatcaatgctgaaaaattcgctgaccctaaacagaaagctgatgtagaaagcatgattccaatgggctatatcggcgaaccggaggagatcgctgcagtagcagcctggcttgcttcgaaggaagccagctacgtcacaggcatcacgttatttgcggacggcggtatgacacaatatccttcattccaggcaggacgcggttaaacaaaaaaagcgacccagacatcacatctggatcgcttttttattacgcacgctttttcttaacaagtgctgctacagataaaataatggcagccgcagacagcacaatcgctgtaatgtctagagctgaagaacctgagttttcggaatcgtcttttgttttcgtggcgctgtgctcatctgtcacttgttttgcagacgtgatgtttgtaatggaatgaggtgtatcggcatcctcgtcacctgtccactcaacaatgctgccgtctttgtaatattggtatgcgtcccaagcagcttcctccgctttgtcagggtttttggcaacaaaggtaaactgctggaactgtccttcctgaatgcctccgtcagtcgcctcccatgtcacggacactgatttgtcatcatgtttttgagtggagaccttccagcccggaattggctcatattgctggaattcaacatccttcggcattttgaggactaccttcgttgtcggcagatttttctctgaaggaaccttcattgtatacgtttcccaagagcctgcagcagactcagccggttttacagaaacatgcgcgctggcaggggccgtaaagaataagagggagccgacaatagccggacatagtgtcaatgcgatttttttcaacaacgtaaacactccttaattggtctttgtaaacatgatattgatttcgttaaagtcgccggtcaggccgtggactttgatcttccagtttcctttttcattaatcgacaggttttgatcctggaagacgccttttgttttttcttttaatgtaaaagtgcttttgttttcgctgcctgacaggcctgttttataaacggttaacgtgatttgctggatgtttttcacgggatctccgttatggtcggtgacccgcagctcaaaaacattttttccgggctggtttgggctgatgctgagagaaacgctttgtccgttctcaatcgctttggtttggtagaacggttccggcgccggctcaggcgggcttggcaggcttgtaaacacggccgctgtgatcaatacagcgatgccgattgcccactccgctttcaacgttcggctgattcctgtgcggcgctgctttctggtaagcagaaaatgaatcgtgcctaagaccagcatgaaaacaaacagcccgcttttcactaaaagagcttgtccgtacgctgtatggaacagtgaatccattgaacgaatgatgaaaaatccattgagcaagcctgaaaacaaaatgacgccgactgcagtgagcgcccatggggagaaccgtctgaccgtctcccacgcgagcgttttgtcaggctgcctccattcttttgagagcagcaaaacgagtgccgctattccgccgacccagatggaagcggaagttaaatgaaggaaatccatcaaaatgccgaccgttttttcttcaacgacagcagcatgcccggtaaacgccttggcaagcaggagaccgaaaaagaaaatgagcggcgctgtccaatagccaaaggatgaaaagcggtttttccgtatcgcagggatgacagacagtgcgagcagcacgaacagcgcagcctgtatgatccaaatggagccgcctgctgtctcaaacagtgtttctctgatgtagcccgcctggaatgcgctgccccagccgccgcctgcgttcgcttttgtctgaatcggaagctgaagcaaaagcgccagacccagtgctgcgatcgagccggtcaggatacgtctcgtccgtttgacgagctgttctgatttccctttataccagaaaagatggaagaaaaccgttccgataaacagagataaggctgtatacagaatcgcgcgatctgctgctgttcccggattcagcgctgaatcggctgctttttggctgctgaatccgccatccgctttcccgatactgaacggaatgacgccggaaacaggatgtccatccgcggatacggcattccattccgctctgtacacatctttaggcagattcttcttcagcttcactgtcatgatgtgatgattatcttttttgatttcagtcttgtccgtatccacacggtcgccgtttgaattatagactttaatgtaatgaaacccttcttcaaccggttcattaaattcgatttccacctgcgcaggggcgctttttaattcgctgttttccccaggtgaagatttgacaatataggcgtgagcaaagcttgttttcggcaggaaaacaagaaaaagcagaaggatgatccaccatctgtttcgcttcatcactcagacaccaccttccgctgtatgtgttgtgttatttcttggtgcaggtgcagcgtttctttcggtcttgaagcatatcttccagcgcttggtcgaaagtgcggacggctccgccgaatcctttttgaaatcgttcggcatggtcaagtgtcgcaaacggaatggcctgcggctggcagcagtgcaggtttaattcagcatttacgacgaaataagccgaaccggcactgacggttgtctgtaacagaaaatctctgcaaatcaagtgtgaaacctcttccgttttatccgcgtaacgcaaaaacgcgcaatgtgcgcagcatagctgttcaatgtcttggtttaccgtaatcagctgaaccgaatgagcttgattgacgggcttcaagcaatagctgcacatatgatccgtttgaggtgttcgggcggggagcgtgatgccgccggccgttttaatgacctgatttgactgaaccagctgattgacatctctgtataccgtcatttccgaaacgccaaaccttgcgctgatgtcagaaattctgagcgcgccttcttctttcagccacttcagtatgtgttgctgtctattaatcggaagcattcatacaccctcttcattaagatctatttaagcgtagaggattttagagacagagacaagtaagctgatgataaaaaatgtgaaaatgtgttgaacaacaacaaaacgaaacagaagggactctggtataatagacatatggaatagaaagtgaggaataccctatgaaagaaacaccatgcccgaactgcggcaaacctttgacaggcgacatggtcagatcatcaaatgtgccttgtcaatttcgctgcggacactgccgggaacggctttatgaatataaagtatcagctccgattatgctggtatcattagcggccatcgtgctgctcatttatcttttgctgctcctccgcaatgcggcaggttcaatgctgccggctgtacagcacgtgccgatggctgtttttgcgcttgtgtgcgcctatcccgtttttattgtgagtgagcgaatgatcgcaaagtacgtgattcaaaatggcaacatcatttatagaggaaagagaaaaggctcctgatatcaggagcctttttatttttaaaaaattgtcacagtcatgtgccaaagtcctctttactttcaattgtatagggactgtaagcgttttaacatagagtcaaagggaagcatcattctctgaacatatttttttatcttacagcgacaaacaaaacagggagggtttatatatgcagcagcaagaacagcagcaaggcggcatgaaagtgaaagtgcaacgctttgggagttatttgagcggaatgatcatgccgaatatcggcgcgtttatcgcgtggggtatcattaccgcgctgtttattccggcaggatggtttccgaatgaacagctgaacacgctggtcagcccgatgattacgtatttattgccgcttttgatagcgtatacaggcggaaaaatgatctacgaccaccgcggcggagttgtcggagcgacagcggcaattggggtgattgtcggatcggatattccaatgtttttaggcgcaatgattatgggtccgcttggcggatacctcattaaacagactgataaattattcaaggataaagtcaaacaaggctttgaaatgctgatcaacaactttacggcagggattgtcggcgcggctttaacgattctcgcgttttacgccatcggcccggttgtcctgacgctaaataaattgctggcggctggtgtggaagtcattgtacacgctaatttactgccgatagccagtgtttttgtagaaccggcgaaagtgttgttcctcaacaacgccattaaccacggaatcttaagcccgatcggaatcgagcaagcatcccaaacaggaaaatcaattctgtttttagtagaagcaaaccctggaccggggctcggcattttgctggcgtacatgttctttggcaaaggatcttcaaaatcaacggctcccggtgcggcgatcatccatttcttcggagggattcacgagatttacttcccgtacattctgatgaaaccggccctgattctcgcagccattgccggcggagcaagcggactcttaacgtttacgatctttaatgccggacttgtcgcggcagcgtcaccgggaagcattatcgcattgatggcaatgacgccaagaggaggctatttcggggtattggcgggtgtattggtcgctgcagctgtatcgttcatcgtttcagcagtgatcctgaaatcctcaaaagctagtgaagaagacttggctgccgcaacagaaaaaatgcagtccatgaaggggaagaaaagccaagcagcagctgctttagaggcggaacaagccaaagcagaagaagcgtctgagctgtctcctgaaagcgtgaacaaaattatctttgcgtgtgatgcgggaatgggatcaagtgccatgggggcatccatcttaagaaacaaagtgaaaaaagcggagcttgacatcagtgtgaccaacacggccattaacaatctgccaagcgatgcggatattgtcatcacccacaaagatttaacagaccgcgcgaaagcaaagctgccgaacgcgacgcacatatcagtggataacttcttaaacagcccgaaatacgacgagctgattgaaaagctgaaaaagtaatcttatagaaagagagtgatactcatgcaagtactcgcaaaggaaaatattaaactcaatcaaacggtatcatcaaaagaagaggccatcaaattggcaggccagacgctgattgacaacggctacgtgacagaggattacattagcaaaatgtttgaacgtgaagaaacgtcttctacgtttatggggaatttcattgccattccacacggcacagaagaagcgaaaagcgaggtgcttcactctggaatttcaatcatacaaattccagagggcgttgagtacggagaaggaaacacggcaaaagtggtattcggcattgcgggtaaaaataatgagcatttagacattttgtctaatatcgccattatctgctcagaagaagaaaatattgaacgcctgatctccgctaaaagcgaagaagatttgatcgccattttcaacgaggtgaactgacatgatcgccttacatttcggtgcggggaatattgggagagggtttatcggcgcgctgcttcaccactccggctatgatgtggtgtttgcggatgtaaacgacacgatggtcagcctcctcaacgaaaaaaaagaatacacagtagaactggcagaagagggacattcatcagaggtcattggcccggtcagcgcgattaacagcggcagtcagcccgaagagctgtaccggctgatgaatgaggcggcgctcatcacaacagctgtcggcccgaatgtgctgaagctgattgctccatctatcgcagaaggtttaagacggagaaacactgcaaacacactgaatatcattgcctgcgaaaatatgattggcggcagcagcttcttaaagaaagagatatacagccatttaacggaagcagagcagaaatccgtcagtgaaacggtaggttttccgaattctgccgttgaccggatcgtcccgattcagcatcatgaagacccgctgaaagtatcggttgaaccatttttcgaatgggtcattgatgaatcaggctttaaagggaaaacaccagtcataaacggcgcactgtttgttgatgatttaacgccgtacatcgaacggaagctgtttacggtcaataccggacacgcggtcacagcgtatgtcggctatcagcgcggactcaaaacggtcaaagaagcaattgatcatccggaaatccgccgtgttgttcattcggcgctgcttgaaactggtgactatctcgtcaaatcgtatggctttaagcaaactgaacacgaacaatatatcaaaaaaatcatcggccgctttgaaaatcctttcatttcggacgatgtgacccgcgtagcgaggtcacctctcagaaaactgggagaaaatgataggcttgtaggcccggcaaagaaaataaaagagccgaatgcactggcggaaggaattgccgcagccctgcgcttcgatttcaccggtgaccctgaagcggttgaactgcaagcgctgattgaagaaaaaggatacagcggcgtacttcaagaggtgtgcggtattcagtcccatgaaccgttgcacgccatcattttaaagaaacttaatcaataaccgatcacccgtgacacaatgtcacgggctttttttactatctcgctatctagtataatagaaagcgcttacgaaaacagggggaggagaatgacgatgaaacaattcgagattgcggcaataccgggagacggagtaggaaaagaggttgtagcggctgctgagaaagtgcttcatacagcggctgaggtacacggaggtttgtcattctcattcacggcttttccatggagctgtgattattacttggagcacggcaaaatgatgcccgaagatggaatacatacgcttactcaatttgaagcggtttttttgggagccgtcggaaatccgaagctggttcccgatcatatatcgttatggggcctgctattgaaaatccggagggagcttgagctttccattaatatgagaccagccaaacaaatggcgggcattacgtcaccgcttctgcatccaaatgattttgacctcgtggtgattcgcgaaaacagtgaaggcgagtatagtgaagtcggcgggcgcattcacagaggcgatgatgaaatcgccatccagaatgccgtgtttacgagaaaagcgacagaacgtgtcatgcgctttgccttcgaattggcgaaaaaacggcgcagccatgtgacaagcgccacaaagtctaacggcatttatcacgcgatgccgttttgggatgaagtctttcagcagacagccgctgattatagcggaatcgaaacatcatctcagcatattgatgcgctggccgctttttttgtgacgcgtccggaaacgtttgatgtcattgtggcgagcaacttgttcggtgatattttaaccgacatcagctcaagcctgatgggaagcatcggcattgcgccttctgcgaacatcaatccatccggcaaatatccgtccatgtttgaaccggttcacggctcagctcctgacattgccggacagggccttgccaatccgatcggccagatttggacagcgaagctgatgctcgaccacttcggagaggaagaattgggggcgaaaattcttgatgtaatggagcaagtgactgccgacggcatcaaaacacgcgacattgggggacaaagcacaacggctgaggtcactgatgaaatctgttcgcgcttaagaaagctctgatgaatcaggccggtggcagatggctgccccggcctgtccatttccttacgaaaatttccacgaaagtctaaccaagcagatccaaatgctgtataataatttggaattcttaggaaagcatcgggtgaaggaagttgaatgcaaaaacaatcacgttaaagaaaaaaagaaaaatcaaaacgatcgttgtactcagtatcattatgatcgcagctctcatttttacgattagattggtgttttacaagccttttcttattgaaggatcatcaatggccccaacgcttaaagactcagaaagaattctggttgataaagcagtcaaatggactggcgggtttcacagaggagacatcatagtcattcatgacaaaaagagcggccgctcatttgtcaaacgtttaatcggtttgcctggtgacagcattaaaatgaaaaatgatcagctatacataaatgataaaaaggtggaagaaccatacttaaaggaatataaacaggaggtcaaagagtcgggtgtaaccttaacgggtgacttcgaagttgaggttccttccggtaaatattttgtgatgggagataaccgtctcaattcactggatagcagaaacggattgggcatgccttctgaagacgatattatcggtactgaatctctcgtcttttatccattcggtgagatgagacaggcaaaataaaatgcaatgcaaaaagaacatggaacatgacggcaccgataataaagcgccgtgcacgtttaaaaaaatgatgatgaaacggtgcggagccggctttccgccccgttttttatgatagaaagcgttttgaagaaaagggccctgttgaaataaacagaatcaggattggcgaagccgtgaagcgcatcgaattggtaaatctcaagatgggtatgctgtttttcccgcagttttttgataagaagcgctacgtcaaacgacggctcataattagggaaaaacaataggaccgggcaggctggcacgtgatgaagagagtcgcgtatccgggaaccgtaataacaaaccgatccgctcacctcaggcatactgctgcatttccatgcgatagtagcccccacgctgaatccaatcacaaagatgtgccgtccggcgttttgcctgatcacattctggatgatggtttctcccgttttcagccgttcgtgttttgtaaattgttcgtatgccgttttttcttcttgcagtgtgtagacttcattctcgccgagcaggttgggcgtcaacacatcatatccagccattttgatcagccggcccatctttttcatatggctgtttacaccgtatatttcgtgtacgagaatgacaagcggttttggggacataacggcctccttttgtgttttttccattatatcctatcgtttcactttaggctgagatataatggtcaaaaaaggagatataaaatgaactcattatctttgcctcaccgctatccatttttgtttattgatggcgtgacggatagcgagcccggcaaacatgcggcagcttataagctgattagtgagaacgactggtttatcactgatacgcaaacagaaatgccgttttcacttgtgattgaagcgcttgcgcaaaccgcggcttttacaggaattacagatgagaacagcttgggattattgtcttcggtgaagaaagcggaaaagctgggagaagctgtgcctggtgaccggcttgatcttacgtttgaagtcacgcgcaatcggcgcgggtttgtgttcggacatgccaaggcgtcagttggagagcagcctgttgctgaagctgaaatcggcatctatattgaaaaatgaaaaaaacccttcacaacattttgtgaggggttctattttgtgtcgtaatcccgttcgctttgagagttatctctttgctggcgtttgtgtttttcatcattcatattttccttcagctcttcattaggaatcggatcggttaagtcgttgtgctcggggttttcatttggtttgttttgctgttttttttctgtcatgtttgatcacctcaccgtttgttttcctcttatccgttctcctcaaacataggaaaccgcttttttgtcccgctgggtataatgtattagaatagagagaagcacaacaaaaagataaagagaggtacatatatgtctgttcaaagagaagatgtagatatcaagctgatcgcaattgatatggatggtacactgctgaacgacgagcagctgatctcggatgaaaaccgcaaagccattcgtgaagcggaggataaaggtgtgtatgtggtgatcagcacgggccggacgcttatgacgtgccgggaactggcggaatcgctaaagctgtcatcctttctaatcacggcaaacggcagtgaaatttgggattcgaattttaatttggtggaacggaagctgcttcatacggaccatattcaaatgatgtgggatttgcggaataagcacaacactaatttctgggcttctacggtgaataaagtatggagaggcgagtttccggaaaacattacggatcatgaatggctcaaattcggctttgacatcgaggatgacgatatccgaaacgaagtgcttgaggagctgagaaaaaacaaagagctcgaaatcacaaattcaagtccgacaaacattgaagtcaacgcgcttggcatcaacaaagctgcagcccttgccaaggttacggaaaaactcggctttacaatggagaatgtgatggcgatgggcgacagccttaatgacattgcgatgatcaaagaagcgggtcttggcgtcgcaatgggcaatgcgcaagacatcgtaaaagaaacggctgattatatcacggatacaaatattgaggatggtgtcgctaaagcgattcgccattgggtactataaaaaaagagagtcctaagatggactctcttttttagtttggcaggttttattctgggaccatggtaggttttctgacaaaagtatttcacaaactgatatgattcacttataatgaaataaagttcaaaaattcggaatagtcgttccgaatttcgggacaataaatgacataaagcatatcgtttgctttggcaggagggattctgtgtttcagattgatttaaactgtgatttaggagaaagcttcggagcctacaagataggccttgaccaagatattttagagtgtgtgacatcagcgaatatcgcatgcggatttcatgcaggagatcctagtgttatgcgaaaaaccgtcgcgcttgcagcagaaagaggcgtgaaaatgggtgcgcatccgggcttgccggatttactcggttttgggcgccgcaatatggcgatttctcctgaggaagcgtatgatcttgtcgtttatcaaattggcgcgctctctggctttctaaaagcagagggacttcacatgcagcacgtcaagccgcatggcgctttatacaatatggcggcagtcgatcaaaaactgtcggatgctatcgcgaaagctgtctataaggttgatcccggcctgattcttttcggtcttgctgagagcgagcttgtaaaagcgggagaacggatcggacttcagaccgcaaatgaagtgttcgccgacagaacataccaatcggacggcacgctgacaccgcgctcccagccggacgcactcattgaaagtgatgatgccgccgtcacccaggtcatcaaaatggtgaaagaaggggcggtcaaatctcagcaaggacatgatgtgtcattaaaagcagatacagtctgcattcatggagatggagcccatgcgctgacatttgcgcaaaaaatcagaaaacagctcaaagcggctggaattgaagtgacagctatttcagaacagaggtcaacataaaggaggaacaatagatggagcagcagaaaaagacagcaggaaaaaaagcgggcagctggtcattgctgatgggcgccgcctttttaatggcgacatcagcaatcggaccgggtttcctcacccaaaccgcaacattcacaaacacactcgcagcaagcttcggttttgtcatcttaatctctattattttagatattttcgcccaaaccaatgtgtggcgcatcatcgcagtttctggaaaacgaggtcaggaaattgcgaatatggtgcttcccggactgggatatttcatcgccattctcgtcgtgcttggcggactagcttttaatattgggaatatcggaggggccgggctgggacttcaggtgctgttcggcattacacctgaaacaggcgctttaatcagtgccgttatcgccattttgatttttgtcatcaaggaagcaggaaaagcgatggaccgttttacgcaaatcgcggggttcgtgatgattattttaacggtctacgttgcggcgacgacagctcctccagtcggacaggcagtcgcaaatacattcgtcccggaacacatcagcatatttgccattgtcaccctagtgggcggaaccgtcggcggttatatcacatttgccgggggacaccgtttgcttgatgccggaattaaagggaaggaatccattccgcaggtgacaaaaagctcggttgtcggcattttaattacatctgtcatgcgtatcgctctttttcttgcggttctaggcgttgtatcgaaaggcctgcacatcgatgaaagcaacccggcggcttctgtcttcaagctggctgctggaaatgtcggttataaaattttcggattgatcatgtggtctgcggcgattacgtctgttattggagcagcctatacatctgtttcatttttcaagaccttttctccaaaaattgaaaagaattcacgcggtattattatcggatttattgtggtttctacgttagcttttgtcacaatcggccagcctgcgaagatcctcgtccttgtcggttcactgaacggcttaattctgccgattgcgctcggaacgctgcttgttgccgcctacaagaaaaacattgtcggtgattataagcatccgctttggctgacaagcacaggcgcgcttgtagtgattgtaatggcagttatgggaatctacacgttaattacacaacttcctcaattgtggagctgatataagtggagcaattaaacaaaatggcgccaaaggatgtacgcgccctgatacgagaggggaaaataaacgggccgaccgcaggcatgtctggcggctacgcccaagcgaatcttgtggttttgaaaaaggaccttgcttttgattttctgctgttttgccagcgaaatcaaaagccctgccccgtgctggatgtgactgaagcaggttcgcctgtgccgtctctggctgcgccggatgctgatatcagaacggactttccgaaataccgtatttacaggcacggtatcctaacggaagaagtatctgatattacgccatactgggaggacgattttgtcggctttctgatcggatgcagtttctcctttgaacaggcactaatcaataatgggatagctgtccggcatattgatgaggggacaaacgtctcgatgtataaaacgaatatcgattgtgttccggcgggggcgtttcacggacagatggttgtcagcatgaggccggttcctgaacggctggctgtacgtgctgcacaagtgacctcgcgttttccggctgtgcacggagggccgatccatatcggcaatccgggagcaatcgggattcgcgatctcgggaaaccggatttcggagatgccgttcccattcgtgacggcgaggttcctgttttttgggcatgcggggtgaccccgcaagccgtggctatgaatgtaaagcctgaaatggtcatcacacatgcgccggggcatatgctcatcacagatattcgagacgagtcgcttgcggtgctgtagcctctcgtcatcctgatgaacgagaaataaaagaggtgagaaagatgactgtacgatatcaaatcgaacagctcggtgattctgcaatgatgatccgattcggagaagaaatcaatgaacaggtcaacggcattgtccatgccgcggccgcttatatagaagaacagccatttccgggattcattgaatgtatcccggcttttacaagtctaaccgtattttatgatatgtatgaagtgtacaagcatttgcctcaaggcataagctcaccttttgagagtgtcaagcgcgatgtcgaagagcggctggcagaaatagccgaagactatgaggtcaaccgccgtattgtagaaattcccgtttgctatggcggtgaattcggtccggatttagaagaggtggcgaagatcaatcaactgtcaccggaggaagtaatcgacattcatacaaacggtgaatatgtggtgtatatgcttggcttcgcgcccggttttccttttctaggcgggatgtcaaaacgcattgcagctccgagaaaatcatcgccaagaccgtcgattcccgcaggttcggtcggtattgcgggattgcagacaggcgtttatccgatttcaacgccgggcggctggcagctgatcggcaaaacgccgctggctcttttccggccgcaggaaaacccgccgacattgctgcgggcgggagatattgtgaaattcgttcgcatctcagaaaaagactatcacgcctataaggaggagtccaattgagcatgaaagtattaaagcccggactgctcacaacggttcaggatataggcagaacgggttaccaaaaatacggcgttctggccagcggcgctatggacacggtttcactgcgcattgccaatctgttgataggaaacggcgaaaatgaagcaggtctcgaaataacgatgatggggcccggtccgtcgtttcatttttcaaaacagacactgattgctgtgacaggggcggacttcacgctgcgtattaatgacgaggaagcgcctttatggaagcctgtgctcatcaaggaaaacagcacggtcagctttggcccctgcaaactcggcagccgtgcttatttggcggcagctggcggcattgaggtgcctgccgtcatggaaagtaaaagcacatacgtcagaggaagcattggcggacttcatggcagagcgcttcaaaaagaagatgaactgaacattggagagatgtcagctctttcgcaaaccatcctttcccgcttaagttcgcagcttggaaaacagggatttgcagcaccgaagtggtcagtcagccgcggcagatttctgccattgaagaagaatcccgtcattcgggtgctggaaggaaagcaatttgcctttttcacagaagaatcaaaaacgcgtttttatgaagaagcatttcgtgtcacgccgcagtccgaccgtatgggctacaggctcaaaggagaaccgctcgaactgaaggccccgcttgagatggtgtcggaagcggtttcattcggaacagttcaggtgccgcctgacggcaacccgattatcctgcttgcagaccggcagacgactggcggctatccgaggatcgcgcacatcatatccgctgatcttccgattgtttcccaaatcatgccgggcgagcacgttcagtttgagcctgtgtccctccaggaggcagaagcgcttgcggtagaacgggaacagcatataaaagaactgaaaacgagaatgaagatggaatggctgacatagcaaaggggatgaatgatgcagaataaaaataaaaccgtagtcaaatctatggcgctgcttaatttgtttttgcataaaccaagcctaaccttaagtgaactggtgtcgctgacgggaatgccgaagacctctgttcaccggatggtcagctccttggaggaaatggggttcctcagtagggatgcgtccggcgcttattcgctgggattggtgtttttggaattcggacagcttgtcgctgacaggctggatatcagaaaaatagcgaaaccggtgatggaagagctgtgccgggaagtggatgaggccgtgcagttgatcatgagggacggcaatgaagcgatatacgttgagaaaatagaagggacacagactgtgcggctgtatacggcgatcggcaggcgttcccccctatacgcgggagcgtgcgccagaagcattctgtcctttcttccccgtgaagaaatcgaagcatacatcaaacaaaccgagctcatttcgattggctccggaacgattaccgatcccgaaaaactgcttcaggagattgatgcctctgtgcaaaatggctatactgtcagctattcagagctcgaaaactatacggcggcgatcggcgccccgatctttaaccatgagcgccaggtggcagccggcattagcattgcaggctttgaagcgagatttacagaagacaggctgccctatttaacagaaaaggtgaaggacgccgctttacagatttcaagaaaaataggatatacataagtagccaatcttttctctgctgcgtacattaacgtatcgacgttcaagagtggaggaaagaacatggtgcttcgatatacagctctgggcgattccttgacgacagggagaggctccgggctgttttcacccggcttcgtccagcgttttggggacatgatggaagctgacttgaaaacaagaacggcaataaacatatttgccagatcaggcctgaatacagaagagattttgggactcctgtcatatccctatgtgcaaaaatgtattcgagatgctgatatgataacgatcacagggtgcggaaacgatctcatcgattcggtcttagcctaccaaacctctaaggatgaaacgattttcagccgtgtatccgcccattgccatgagaattttgaaaagatgattgccaaagtcgccgagattaaaggagaaaatccttccccgtacgccattcgtgtgttcaacttatacaatccgtttcccgaaattgatatcgccggcaaatggatcacttcgtttaattcacatttagaaacacttgcatcagcaccccatgtcaaaatcgcggatgcctatagcatcttcaaaggcaaagaacaggaatatctgtcctttgacggtgtccatccgaacagcaaaggctatcaagcgatggctgaagccgttcacaagctaggctataaagaattatcagtttcatagaaaacgcgcctcatgacaggcgcgttttttatgtgtgatcgaaatattaaaagaaacttaaaattctctgtcttctgttctacagacaaacaaagtgcgctagaataatggagggcgtaggcaaatatagccataacgttcaatatttcgtatataaggaaggatggtccttttgtttcggatttttaaaatgtcttttgcggttatcattattatactggcgcttattgcttttaactatacggaacacacctctgttatccaatcggtcatgctcgtctttcttggtgcggtcatgtttatgcaggggcttgaagaacgcaaaaaagaaaatgacggctcaggcgcttttaatatttataccgccgtttttgtatggtctgtctcccttatcggttttacacttcatattatataaatctattacacatcctgaaaatgctcgaccgtcgggaacggggtatagaaccgatgaagcaaggctttccactcttgatactctgaagaaccgcgaaagccttccgtatggtcctcaagtgtttcccactccacaagaagcagatatttatgcgtttcctccatgcattttgataacgagtgcgtgatatagcccttcatgccggaaataatcggcgccgcttgccggaatgcatcctcaaactcttgttcaaggccttctttaatgtgaagcattgctgcctccctgaccatgctatcccttctttctgtcttttcgaatagtctacagcaaacgataggagatttctgcaaaatcggtgaacttttccttcattttcaaaaaaatcttgcacgcaccaattcaattaagagaaaataacaagtggaaggcaggggaaagtcatgttaaaaaagtgtattctactagtatttctatgcgtcggattgattgggttaatcggatgctccaaaacagattcaccagaggatcgcatggaagcattcgtgaaacagtggaacgatcagcaattcgatgacatgtatcaaagcctgactaaagatgtcaaaaaagaaatctccaaaaaagatttcgtcaacaggtataaagccatctatgagcaggccggcgtaaaaaatttgaaagtcactgcgggagaagtagataaggacgatcaagacaacaagacaatgaaacatatcccgtataaagtcagcatgaacacaaatgccggcaaagtcagcttcaagaatactgctgtgctgaaattagaaaaaacagatgacgaggagtcatggaatatagattgggacccatcgtttattttcaagcagctggctgacgacaaaaccgtgcaaattatgagcattgaaccgaaacgaggccaaatttacgataaaaatggaaaaggtttagctgtcaatacagatgttccggaaattggaattgttcccggagagcttggcgataaaaaagagaaagttataaaagaactcgccaaaaaacttgatttgactgaagacgacatcaagaaaaagctggatcaaggctgggtaaaagacgattcgtttgtgccgctcaaaaaggtcaagcctgaccaggagaaattagtttctgaagcgacgtcattacaaggcgtaacaagaacgaatgtcagctcccgctactatccgtatggcgaaaagacagcccatttgacaggctatgtccgcgccattacagcggaagaactgaagaaaaagaaagaaggaacgtacagcgatacgtctaacatcggtatcgccggacttgaaaatgtgtatgaaggcaagctaagaggcacaactggctggaaaatctacgtgccgcaaaccggggaagtcatcgctgaaaagaaagcaaaggacggcgaggatcttcacctcacaattgatatcaaaacgcaaacgaagctgtatgatgaactgaaggatgacagcggggcggcagtcgcgctgcagccgaagacaggcgaaacactcgcccttgtcagcgcgccttcctacgatccaaacggatttattttcggctggagcgataaggaatggaaaaagctaaacaaagataaaaacaacccgttttcagcgaaattcaataagacatacgcgccaggttctaccattaaaccgattgcggctgctattggaatcaaaaacggcacccttaaagccgatgagaagaaaacaatcaaaggcaaggagtggcaaaaagattcgagctggggcggctattcagtgacacgtgtgtctgagagacttcaacaagtcgatttggaaaacgcccttattacgtcagacaatatttattttgcccagaatgcgcttgatatgggagcggacaccttcacaaaaggcttgaagacattcggtttttcagaggacgttccgtacgaattcccgatccagaaatcgtctattgcaaatgacaagcttgattcagacattttgcttgcggatacaggctacggacaagggcaaatgcaaatgtctccgcttcacttggcaactgcttacacgccatttgttgacaatggagaccttgtcaaaccgacgctgatcaaaaaagattcacaaacagctgatgtttggcacaagcaagtggtcacgaaggaaggagcggcagacattacaaaaggtctgaaaggcgttgtggaagatgagcgcggatcagcgtatcagcctgtcgtgaaaggaatcacagtggctggaaaaacaggaacagccgagctgaaaacatcaaaagatgataaagacggcacggaaaatggctggtttgtcggctacgattacaaaaacaaagacctgcttgtcgccatgatgatccaaaatgtgcaggaccgcggcggcagccactatgtcgttgagaaagcgaaaaagcaatttcaatcgaattaaaatgtctttttaaaaggagcgaaaggaaaaagaggatctgaggccgaatgaactagtaaggggcaaaacccggtttatacaaagaaaagagggattttgcatgcagcgtattcaattggcggaggatcttcaattttcaagagtcatacacgggctttggcggctgaatgaatggaactattcagatgctgaacttctaagcctcattgaatggtgtatcgatcacggcatcacgacctttgatcatgcggatatttatggaggctatacgtgcgaaaagctgtttggaaacgcccttgccctttcgcctggattaagagaaaacatagagttggtcacaaaatgcggtatcgttcttgaatcgcctgaacggcccgctcacagatcgcatcattataacacaagcaaatcgcatattttggcatccgttgagcaatcgcttatgaaccttaggacggattatatcgatatgcttttgattcacagaccggacccgctcatggatccggagggggtagcagaggcgtttcaggccttgaaatgctctggcaaggtcaggtactttggcgtttcaaattttaaagatcaccagtatcggatgctggaatcatatttgcctgagaagctcgtaaccaaccagattgagctttccgcatacgaattagaaaatatgctcgacggcactttgaacctgtgccaggaaaaacgtattccgccgatggcttggtcgcctctggcaggcggcaaagttttcactggtgacacggaaaaagaccggcgtgtccgcacggcgcttgaatccgttcaagcagagattggcgccgcttcattggacgaggtgatgtacgcatggctgtatacgcatccggccgacatcatgccgattgtcggaagcggaaagcgcgagcggatttccgccgcgataaatgcgttgtcatacaagcttgaccaggatcaatggttccgcatttttacagccgtacagggttacgatattccataaaaagcatcagcttaccagctgatgctttttcaatattgtcacaccgcatagtgccaaattaccatttataagtgattgattctttcttgaaagcgttttatattaaaaggaaacctctctatatcctctactgcatctccttgcgacttcatccgcacatcaagattgtctaggaggtcttttttatgtatatgactgccagagaacaaaagctgttaaagcacttattattacaaaacagatatataaccgtaactgagcttgctgagctgatgcaagtcagcacgagaaccattcacagggaactcaaatcaattaaaccgctgatggaaaccgttgggcttacgttagataaacagcccggtaaaggtttgaaagcagtgggaagtcccgaagataaacaaaagctgcttactgatttatcatatgaacagcatgaatacagcgccgacgaacggaaactgctcattctttgttcgttattagagtctcaggagcccgtcaaactgtacacgcttgctcatgatctccaggtgacgaatgccacggtcagctatgacttagatgagctcgagaagtggatttctcccttcggactgacactgatccgcaaaagaggttttggcatccagcttatagggccggagaatgcgaaacggaaaattgtcggcaacttgattgtgaaccgtctcgacatccaaatgtttttggaagcggttgaattaaacatcaaaggaaaaaccgattcttcagagaaaatgttcggggttgtcagcaaaggtgagctgttaaaaatggagcgcatcttatttcagctcaaagaaaaaatcgctttttcattgtccgacagctcctatatagcgctcgtcgtccatctgacgtatgctatcgaacgaattaagcttggggaaactatcaccatggagcaaaatgagcttgaggaactgaagaatgcgaaggaatacagctccgctcttgaaatcgcgggcgagcttgaacgtgccttcggcgtgacgattccagaggcggaggtcggctatattacaatccaccttcgaagcgccaatcgaaaatacaaaacagaatacaaagcgcaggaaattgagctggaaacagccctgcaaacaaagcggctcattgcttttatttcagacaaaatcagaatggatctgacgaaaaactactctttatatgaaggcttgattgcccatttggagccggccgtcagccgcataaaagaaaatattgagatatacaatccgatgaaggaacagatcaagcgcgattattttctgctttatatggcgatcgaagaaggtgtcgaaaagtattttccgggcatgtccttttctgatgatgaaatcgcttttatcgttcttcactttggctcggctcttgaaatcaaaaaagaagaagcaaaagtgaaagcgcttgtcgtctgctcaagcgggatcggctcctcgaaaatgcttgcctccagactgaaaaaagagctgccggaaattgaatcgtttgatatgtcatccctgatcgagctaaaggggaaggatgttcaagcctatgatatgattgtgtccactgtaccgattccttatgaaaacattgattacatcatggtcagcccgctattaaatgaggaagacgcaaaccaggtcaagcagtatatcaagcggaagattccccttattcttaacaaaaaaagaagcccgaaggaagaggcgcagcaagctgatgtacctgacatgctagaggcggcggaaagcataggccggtatatggaagttatccaagatgttctgcgccattttacgctagctcaactcaaaacaaacccggaccatagcatgcttctgctagagctttttcaacagctgaagaaggatggcctgatccgtgatccggaaaaagccgcggtttgcctggctgagcgggagaaacaagggggattgggaatccccggaacaaacatggcgctttatcatctcaaaaatgatgaaatcgtcctgccttttttcaaaatgtttgatctcagcacctcctatgaagtggatggcatggacggaaataccctcaggatgacacgcattctcgtcatgatggcgcctagctcattatctgctgaaggctcggagattttaagcgcgatcagctcggcaattatcgagagcagagaaagcatggcggggtttcaggaagaaggagaacaagaattgtatcagcggttaaaccgcatatttttcacatggatgaaagaaaaaaacatactgtaaacctgcatggcacacgtcaaaaatttggcgtgtgtttttctgtggatggggaacaaaataagaaaatgtgggactattttatcattcagtattggaataattccaaaatgaaatagttttacaagttatcttttttgggttaaaatgggtgaggcaaggaagaaaatctaacaaattattgaagattcaagagaatataggagatgacgatatggaaacattacagcatctgattctgcatgacatgccgaatagcgaagaaatagaggctgtaaaaagcggagaccatacactgacatataaaggttaccgtaaacggattaatcagctggcgaatgccatgcttcaaaaaggaattcaaaagggcgaccgtgttgcattgctttgcaaaaacggccatcccgcatcaactgttatgttcgccgcgcttgaaataggtgctgttgtcgtacctgtcagctggcagctgaaaccatatgaaatgacaggcattttaaaagcaagtgaaccgaaagcgatgttttacggagcggagtttaaagagatactggatgaagttctacctgaattgtcctcactgtgtgtaacaatggaaacaggaacagcttacgaaacatctgctgaatttgaagcgctgtttgcaggtcctgatcatttgccagagacggaaatggtttcacctgatgatacagcacttctgatgtttacatctggaacaacgggaaacccgaaaagatgcatgattacacatggcggcatatacagatacgttaaaaaatccaacagctcaatagcacgtatgaagggccttcgttttctcgcgtgccatccgatttatcatacgagtgcgctcatttgcatcatgcttggaacgtttgcagaaacaacctttgtgtttacaaaggatcaagatcctgttcacatgctgaaggtcattgaagaagagaaaattcagaccgtgatggctcttcctgtgttttacacgtatttgcttgaggcgtgggaaacgcaccaaactgacttatcttcacttgttattttaatgacaggcggaacaaaagtgccgagcagcctaatccgccgctatcttgatattggcattccgctcgcgcatggctatggaagcactgaggcttggggcatcagcacatggacgcctgatatgggaatggataaagcggcatctgcaggaaaacctgtggcaggtgttaaagtcaaagtggaagatcctctgaccggagaagaacttcctcaaggagaaatcggcgaaatcgttgttcatactccattcttatttaaaggctatgaagacaatcctgaagcaacagcgaaagtgctgcaaaatggatggtttagaaccggagattcaggatatgtagatgaagatggctttattttcatcacgggacgctacaaggatgtcattatttacggaggcgataacgtctatcctgatcaggttgaagaagttatccagcagatcccgggaatccttgaaacggctgtggtcggtattccagacccgctttacggtgaaaaaccgaaagcttttatcgtgaaaaatggcggccagcgcatcacagaagaggatgtcatcgcattttgtaaagaacgcctgtccgcttacaaaatacctgaagttgaatttgttaacgaactgccgaaaaacaaccttggcaaggtgaaaaaagacgtcctgcgcaatcaggctgtacattcataaaagaagaagcccgtccactttatgtggcgggcttctttgcacttgcacagacggaaagctcaggcttaatgttcttaaattgtatatcaatgtcttcgaagccggctgctttaaagtcagcaatcatctgtcttccaaatgatttggttttttcaggactggcatccgcttcccgcggctgcatcgtaatggctgctttgccgcctggctttaatgcccgataaatctgtttcatgccttttgtttggtcattccaaatggtgtagttgttaacggaaatcactttatcataaaacgaggcggggagaggaaatgtctcgatgcttccttgtatcaggcgtacgccctttggtttcactctgcgggcggccagcttcagcatggcctctgacacatcaatcccatgaagatgaacatccttctcgcgtttcagcatctgctgcatgcagtatcccgggccaaacccgacttctaaaatgctgtccccgcgcgtgatacccagctgattgattgtccactgattcagtgtttgattttcagcagccatgatgtacccggcaatcatgccgatgacgccctttggcctgctgaatcttctagaaagcatgttaatcattcagcaaccaaccccctttttgagttaatttcctcccagcgttccatgtgaaacatttttctgataaagcaatgcgaaggtgccaagccatgtttatccatagagtgtgtgaggtacacaacaaatagacatgaaaacaaaggaggagaatcatcatggcaaattatccaaaagaactgccggcacaaactcaaagtcgccagccgggaattgaaagcgaaatgaatccaagtccggtgtatgagtacgaggattataaaggagcagacaaattaaaaggaaaagtagctcttattacaggcggcgacagcgggatcggacgcgcggtttccgtcgcttacgcaaaggaaggcgcagacatcgccattgtgtataaggatgagcatgaagacgctgagaagacgaagaaacgtgttgaacaagaaggcgtaaaatgcctgctgattgctggtgacgtaggtgaagaggaattctgcaatgaagcggttgaaaaaacggtcaaggaactaggcggccttgacatccttgtcaacaatgcaggtgaacagcatccgaaggaaagcatcaaagatattacgagcgaacagcttcaccgcacattcaaaacaaatttttattctcaattttatttgactaaaaaagcaattgattacctgaaaccgggcagcgccatcatcaatacgacatccatcaacccgtacgtagggaacccgacactgattgattatacagcgacaaaaggggcgatcaacgcctttacaagaacaatggcgcaggcgcttgttaaagacggcatccgtgtaaatgcagtcgcgccgggtccaatctggacgccactaatcccagctacgttccctgaagaaacagttgctcaatttgggcaggatacgccgatgggccgtcctggacagcctgttgagcacgtcggctgttatgtgctcctggcatcagatgagtcctcttacatgacaggacagaccctgcatgtcaacggcggaaactttgtgacgacataagagggagtgagacatatgagcatcacgaaagaagaagtgaacagctactatcaaaaagcagggattgtattaacggacgaggaagtagaccaaatccagctgatggattacggcttaggaaaagaaagaaaagtcgggctccagctcttcgtctacgtcaatacagaccgttattgttcaaaggaattggtgctgtttccgggacagacttgcccggaacaccgccatccgccggtcgacggccaggaaggcaagcaggagaccttccgctgccgctacggaaaagtgtatctttacgtagaaggagaaaaaacgccgcttccaaaagttctccctcctcaggaagacagagaacactatacggtctggcacgaaattgagctagaaccgggcgggcaatacacgattccaccaaacacaaagcattggttccaggccggggaagaaggtgccgtcgtgacggaaatgtcatcgacgagtacggataaacatgatatctttaccgatccaagaatataaggatgggcttaacagcccatcctttttgtattgaaaaaaacagaatcatcgctataatggttaaaaaaggaaagagggcgaggcaatgttcacttgcaaggtaaatgagcacatcaccatccgattattggagccgaaggatgcggagcggctggccgaactcattatccaaaatcagcagcggcttggcaagtggctgttttttgcggaaaatccaagcagcgctgacacgtaccgagaaacaatcattccagattggcggcgccagtatgccgacctgaacggcattgaggcgggtctcctttatgacggcagcttatgcggcatgatcagcctgcataaccttgatcaagtgaatcgtaaggcggaaatcggatattggattgccaaagaatttgaagggaaaggcattattacagctgcctgccgaaaactcattacgtatgcttttgaagagcttgagctgaatcgtgtggcgatctgtgcggctgtcggaaacgaaaaaagcagagcggttccggagcggctcgggtttctagaggaaggcagggcacgggacggcttatacgtaaacggcatgcatcacgacctcgtctactacagtctgttaaagcgtgaatgggaaggcgaaaaataaagagcacactttcttgtttaaatcttccccggatgtggaaaagtaacagcggagacgttaaaaaggagtgattcgagatgaatcagcaagacattaaacaaaaagtgcttgatgttctagatcaccataaagtaggttcgctcgcaacagttcaaaagggcaaaccgcattcccgctacatgacttttttccatgacgggctgacgatttacacaccgacaagcaaggaaactcataaagcagaagaaattgagaacaaccccaatgtccacattttattaggctatgattgtgaaggttttggcgacgcatatgtcgaagttgccggaaaagccaaaatcaacaattcggcagaactcaaggacaaaatatggagttccaaattagagcgctggtttgacggcaaggatgatccgaatctggtgattcttgaaattgaaccggaggatatcagattaatgaatgccggagagaaaacaccggtctcactcgaactataaaaaatttgtgttttcaggggcgatatgttattatgaatagctagtaagaaaaataagcaaataaaaaagaaagtaaacttcttttttctgttttgagagagaagcttaccgcttcccaagcagcataaccagctgcccttattcttttccttcataacaaatcgcccctaacgatgagatggaaaaaagacttttttgttttacaattcacaccggcgcggcttcggagccgcagtgacgattgagaggtagggctttcgttgtcttgtgttcaagaaatttccatggtgtttactttccagaatgattcttcggaacaatgctttatgaatctaacccgcctgacttggcggatgatataatctttatttgcgtatagaaaagaataagacaaaccgcccggcgtacgccggacggtttttttattgcaaaaaacacatcgtactgaaacctccttgtcttctttccagtcttatctctaggatgaaattggaggaagaataacgtgcatgtcattacaacacaagtactttttattttttgttttttattgctgattcactcgatagaaaccttagcctatgctacaaggctttccggggcccgcgttggatttattgcgtccgcgctttctctgtttaatgtcatggtcatcgtatccagaatgtcgaacatggtgcagcagccctttactgggcatttaattgatgctgctggaaaaaacgcactggcgattgtaggggagcagttccgctttttaattttcggatcgacagtcggcaccattttgggcattatcctgctcccgtcttttgtcgctcttttttcacgggcgattattcacttggcgggcggcggcggctccgtttttcaagtattccgaaagggattctcgaaacaaggattcaaaaatgccctttcctatttgcgtctgccgtccatttcatatgtaaaaggatttcatatgcgcttgattccgaagcgtttgtttgtcatcaacatgctgatcacatcgatttatacgattggcgtgctttcggctttatacgcaggccttctggcgccggagcgcagcacgacagccgtcatggcttcgggtttgatcaacggaattgcgacgatgctgctggccatttttgttgatcctaaagtatccgttctagctgatgatgtggcaaaaggaaaacgaagctatctctatttaaaatggacctctatcacaatggtcacatcaagggtggcgggcacactcctcgcccagctcatatttattccgggggcctactatatcgcgtggctgacaaagtggttttaataagaaaggctggatcataaagatccagccttttttgcattcccttatttatatttccttaatccgcggtcgtacaaaaaatttccgaatgggacgaaagcagcgacgaagccggcagctgaccatttcagcggccatttgacagagaaggttgcataagccaagacaagcaaatacaaaatgaacaacccgccgtgaaccgaaccgacaattgtcaccgcaagcggaaggcctgcccaatatttaagcggcatagcgatgaacaacaggattaagagtgacattccttcaataaaacccatcgtgcgaagtcttccgatcggcgtgtgcagcataaatcgccctccttgtggacacgttttcattttatactataaacaatccggaggggcatatgacagctttcaaaaaatgttcggaaaacattcatttttacatgccttttctagggaactgtacttgtcatttacaaaaatacccgagataatgtgtacaaaatcaaaaaagaaggatgttgaaatgaaacttgaccagattgatctgaatatcattgaggagctgaagaaggacagccgtttgtcgatgagggaattaggcagaaaaattaagctgtcgcctccatctgtgacagaacgggtaaggcagcttgaatcgtttggcatcatcaagcaatacacgctggaggtcgaccagaaaaaacttgggcttcccgtttcctgtattgtggaagcaaccgttaaaaacgcggattacgagcggttcaaaagctatattcaaacattgccgaatattgaattttgctaccggattgcaggtgcagcctgctatatgctgaaaatcaatgccgaaagcctcgaagcggtagaagatttcattaacaaaacatcgccctacgcgcaaaccgtcactcacgttattttctcagaaattgacacgaaaaacgggcgcggttagagagtgccgcgtgaagtctgttataataacaggatgagcgcgaaagaaagagaagtgatcaagcatgtcaaaaacagttgtattagctgaaaaaccttcagtcggccgggatttagcccgggtgctgaagtgccataaaaaaggaaacggttatctcgaaggcgatcaatatattgtgacctgggctttaggccatttggtgacgcttgctgatccggaaggctacggaaaagaatttcaatcatggcgcctagaggatctgccgattattccagaacccttgaagcttgtggtgataaaaaaaaccggaaagcagttcaatgcagtcaaatcccagcttacccgtaaagacgtcaatcagattgtcatcgcgactgacgcaggccgggaaggtgagcttgttgcgcgctggatcattgagaaagcgaatgtccgaaaaccaatcaagcggctgtggatttcatctgtgacggataaagcgatcaaggaaggttttcaaaagctgcgcagcggcaaagaatatgaaaacctgtaccattctgccgtcgccagagcggaagcggattggcttgtggggatcaacgccacccgtgcacttaccacaaaattcaatgcccagctctcatgcgggcgtgtgcagactccgacgcttgccatgattgcaaagcgcgaggcagacattcaggcgtttacgcccgttccgtattacggcatccgtgctgcagtcgacggcatgacgctgacgtggcaggataagaaatcaaagcagacgagaacgttcaatcaagatgtaacaagccgtttgctaaaaaatctccaaggaaagcaagcggtcgtagctgagctgaaaaaaacagcgaaaaaaagctttgcgcctgcgctttatgatttaacggagctgcagcgtgacgcccacaagcgcttcggtttttctgctaaagaaacgctttctgtactgcagaagctatatgagcagcataagctcgtcacatatccgcggacggactctagatttttatccagtgacatcgtcccgacgttaaaagaccgtctggaaggcatggaagtaaaaccgtatgcccaatatgtcagccaaattaaaaaacgcggcattaaatctcataaaggatatgtcaatgacgcgaaggtgtcagaccaccacgcgattatcccgaccgaagagccgctcgttctcagcagtctgagtgataaagaacgaaagctgtatgacctgattgcgaaacgtttcctggctgtattaatgcctgcattcgaatatgaggaaacaaaggtcatcgcagaaatcggcggagaaacctttacggcgaaaggcaaaaccgtgcagtcgcaagggtggaaagccgtttatgatatggcggatgaggatgatgagcaggaggatgacagagatcagacacttcctgcgcttcaaaaaggcgacacacttgccgtccgcacgttaacggaaacaagcggccaaacgaagccgcctgcccgctttaatgaaggaaccttgctgtcagcgatggaaaacccaagcgcgtttatgcagggagaagaaaaaggcctcgtcaaaacgcttggagaaacaggcggcctcggcacggtggcaacgcgtgccgacattattgaaaaactgttcaacagctttttaatcgagaaaaaaaaccaagatatttttatcacttctaaaggaaaacagctcctgcagcttgttccggaggatctgaaatcaccggccttaacagcagaatgggagcaaaagctgtctgcgatcgcggccggcaaattgaaatcggctgtttttattaaagatatgaaggcttacgctcaccaaacggtaaaagaaatcaaaaacagcagccaaaccttccgacatgacaacattacgggaacggcatgtccggaatgcggcaaaatgatgctgaaagtaaacggcaaacgcgggacgatgctcgtgtgccaagatcgtgaatgcggaagcagaaaaacgattgcccgaaaaacaaacgcacgctgcccgaactgccataaaagaatggagcttcgcggccaaggcgagggccaaacctttgcgtgtgtgtgcggtcaccgtgaaaagctctctgtatttgaaaaacgaaaaaacaaagacaaagcgcgtgctaccaaacgggacgtatcctcttatatgaaaaaacaaaataaagatgagccgattaacaacgcgctggcagaacagctgaaaaaactcggtttggataaataataaaaaaacctgtgcctatcgcacaggttttttattggacttaggtcctgttttcttaatgttcaaaaaggggaaaaaaagctagcaatctgcatttttttcttttatagtaaatgtactttgtaacatggcagtcatattttcgtctataactatttgtgagcgtctgatttgcttcaggcgacaaagggggatttgcctgtgaggcatgtactaattgctgtcatcttattcttcttatctatcggactttccgcagggtgtgctgaagctggaaacaagacccaaaatcagtcggcgacagaagtgaatgccagcccgctccagccggcggaatatttcatctatcacaatttaatgaatgacaaagggctgatcaaaaccgatttttcagaccagccttcttacttgtcggaatctctcggactgtggatggagtttctgctcagcaaaaatgacgcaccacatttccaggatcaatatcagcatctgactgattcatttctgatgagcaatcacttggtgacgtggaagattcaaaatggccaagcgagcgggacgaatgcgctgatagatgatatgagaattatgctgtctcttgaccaagccgccgcaaaatggggccgcagcgactacgcgcaaacggctagggatatcggcacgtctttgaagacatacaatatgaacaacgggttttttacagacttttacgactcacaggccgcttcaaaggatgtgacgctttcatacgtcatgcctgatgccttagctgtcttaaagaagaatggaatcatagacgaagaaacagaacagcggaatgccaatgttctctattcagctcctttaaaaaatggctttctgccgaagacatacagctcggagacgaaggaatacacatatgatagtgaaatcaacctgattgatcagctttacgctgcttggcatttgccggaaggggatgaaaaagcatctgttttagcggactggatcaagcaggaatttcagaaaaacggaaagctgtacgggcggtattcggcagatacgaaggagcctgccgtccaatatgagtctccatccgtatatgccttagccgtattgtttttgacaaaacagcatgaaaacagttctgtcatcaaagccatatatgacagaatgaatgactttgaaattcatgatccggtgaaatcgtattatggaggctatatgagcggcactcagacgcattcatttgacaatctgctgccgctgttagccgaaaggaagctttttaatgaaaatatcattcagtgaatcacaaaaattatttgcttatttttcagggctcatcgcggccctgtctttgtttatttattatgtgtcagcccagcaatcagaaggtgctctgatccttttcatcacatttggcgtcatcgccgcaggcatctggttcggcccgatttacgcgctggcagtgaccttaatcgtactctttgttctcggcaccttaatgatgtttttccagactggacagacatcgctctttccggctgaggaagggctgcgaatgcttgtcgtgtggggaatcgcgcttttgctgttttcttttatttctggaagaatccacgatattacagcagagcttcggcgctcaataacacggcttcaatccgaaatcaaaagctatgttgctgttgacagagtgactggttttgataacaagcaaaggatgaatctggaactttcagaagaaatcaagcgggcggagcgctacggcaattcttttgtgtttttgctgctccatatgcattatttcaaagagtttaagtctttgtacggtgaaaaagaaacggaccgcctcttccaatatgtcggtcagcaaatcaggacaagcgttcgggaaacggataagaaattccgtccctctgacgagcgtatcgggatcgtgctgacgcacacgcctgctgaacatatgccggccgttctgaccaagctgaagaaacaattggatacatatcagctggaaaatggaaagtatgtgtcgcttacgttccacgtttgctatttgccctaccgcaacgatatcaaaacagctgatcaatttttagaagaactggaaaacgagatgatgatgaatgaactataaaggaatcacattgctatgcgtcatgatgcttctttttttagctattgcgtcttttcccgtttctgcgcaagcgaaagatcaggatgccggcattctcatcatctactcaaccttggacggcaaagagtcgtcacaagtcaaaatgctcgatttgcttgcgggccactttacatcccatgtgacagtcaaaaaagattcagacgttgaagcgtcggatctcaaagggaaagaccatgtgatttattacggccaaacgaaaagaaagctcagcaaaaaattgctgtctcttatcagcggcgtaaaaaaaccggttgtcgccattggctataacgcaggccaaatcagccaattttccggtctttcattagcccgcaaagaaaatgtgtttcaggttcacagcaggtcggaaaaggccgatgtgtctctggaaagcgggcttaacgtgctgagtgtatcaggcctgaaaggaacggcgctttacaccttcaaagccgatgacggcacaacgcattcttttatatggaaaacaaaaaaagggaatgtgtacattggattaacaaatttgttaaatgacaatttgatcgtggcgaaacagctcagagaagctttcggagagaaggcggggacgacgttattgtatttgcgtctcgaggatatcagcccgatgtctgatgaaaaattgctgcttcaagccggtacatacctgcataagcggcatattccttttatcctggcggtcattccggtttatttgaatccggaaacaggcgacaaagtgtatttgtctgatcaaccgaagatggtcaaggtgctgaagaagctgcaaagcatgggcggcagtatcattgttcacggctatactcacgcttatcgctacagtgaaacaggagagggctttgaattttgggatgcaaaggcggatcagccgattacatccggaaatgccgaagaccccccgtccattttggagaaagaacaggacttcccgaacgaacaagcctatcacagctatctcgaaccatttcgggaaaaggaagaaacgtatacaaaacaaaaactgacgcgtgccattgaggatttgacatcatcgggtctttacccgctggcgtttgaagcgccgcattacacgatgtccgaatatggctatcaaatcgcctcgcagtattttacaagcattttcggccaggtccagctcagcagcacaacatggaaaacatccggtgcacctccgtttgtgactgctccttcgatgttgcacggaatgacgctttatccggaaacgatcggctttgtcgacacatcgaagcaaaactcgctcggtgagatggaggagcacatctcccagatgattgattttgaaggcggagtagccggaggattttatcacccgtacctcgggatgaaatatctgccggagctggttgatcagatggaacgcattccagacagtgaatggcttgatttaaagaaaacgaaacaaaccgtcaaaacagacaaagtggaaattcatacaagcggtgacggaacgattcaggtgaaaaacggcgtaagcgcgattgacgagtttttcgatcatcaccggcaaacccctctggaaaaggcgttatggattctctccgctgttgtgctcttatttgtcatcatgtttgtcagttatacgttttacttgagagccacattgaaaaaacgaatttttaaggagagaagaagccttgggtaatacgctgttctttatctcgctaagtttaatatgggttatgcttctctaccacatgttcctcatgcagggcgggtttcgccactatatgaccttcgaacggaatatcccgaagtggagagaaaatatgaaggaactgccgaaggtcagcgtcctcatcccggcgcataacgaagaggttgtgattcggcagacgctgaaggccatggtcaacctttattatccgaaggaccggctggagattatcgtcgttaatgataattcatcagaccggacgggtgatatcgtcaatgaattttccgagaaatacgatttcatcaaaatggtgattacgaagccgccaaatgcaggaaaaggaaaatcctctgcacttaactcgggttttgccgaatcgaacggcgatgtgatctgtgtgtatgacgccgacaacacgcctgagaaaatggctgtgtattaccttgtgctcggcctgatgaatgacgaaaaggcaggcgccgtggtagggaaattccgtgtcatcaatgcggcaaagacgctgctgacgaggtttattaatatcgaaacgatctgttttcagtggatggcccagggaggcagatggaagtggttcaaaatcgccacgatcccaggcaccaacttcgcgatccgcagaagcattatcgaaaagctcggaggctgggatgacaaagcgctcgctgaggatactgagctgaccatccgggtatataatctcggctatcacatccgctttttccctgccgccatcacgtgggagcaggaaccggaaacatggaaggtatggtggcgccagcgcacccgatgggcgcgcggcaatcaatatgtcgtgctcaaatttttggcgcagttttttaagctgaaacgaaaacaaattatctttgatttgttttattttttctttacgtacttcctgtttttctttggcgtgatcatgtcaaatgcgatttttgtagtgaatttgttttatgatttgcatttgtctgttggatttttggcaatgattctctggattttggcgtttttcttatttatgacagaggtcatgattacgttgagcattgaaaaaacagaaatgaacaagcaaaacttttttatcgtatttctcatgtacttcacatactcgcaggcatggattgtgcttgttatctactctttattcgtagaaatcaagcaccgtttattcaagcaagaggtcaaatggtacaagacagaacgatacaatcaacataaaagcgggtgacctttttgaaacaaataatgatttttctcacaagcttcatgctgctggcgatgactggacaaacggctcttgccaaagacgtacaggtcagcggttcgctcctcgggaaaagcagccaagaacaagccaaacagcaggtgctgacaagcgagttgattacactgtatggatcaaaagacagcgcagagctgacgtaccagatcccggcaggcgcctcttcgggcaatcagcaattggtaatcgaatacgaggcatcaaatcttttaatttctccatcatcgttaacggctgtcattgatgatgaaccggtcaagacgttaaagcttgatggtgattccaaacggaaaacagtgaagctgaatctgaataaaagccagtctgcgcaaggctatcacaacgtatcgctgaaattctacggcgtaatgaaagagggcgtgtgcgtcagacaggatacatcaggcaactggatcaaaatttatccggacagccggctgacacttgctgacagcagtgaagcgaagggaacgtcgctggaccattatccgtatcctttcgcccaatctggaaatacagcggaagaaacagctatcgtcattccggataacccaagttcagcagaaatagaagctgctgttaaaacagaaggctatttgaaaacggtggacagcagtgtcagtattgcgtatgtcacggaatctgaactgaaaaaaatcgataagccgacgattgttatcggcgtggacaagcattggaacggcaaagtgaaaaaactgttgaaacaagctgggctacaggcaaaaggagaaaaccttctgcttgcggagcgggtgctgaaagcagagggcaaacagcagccggttctgtttgcgcaagcggcgtccgaggacgcgctcactaaaaaaatcagcgtgatgacagatcagacatatacaggccagctcagcggcgatacactttcaatcagcaagcttcagcagactgaaaaaaaagaaagcgataagctgacccttgagaattttggagcgggtgatatcacaattggagccgacaaaacatcttcagcacattatttttatccggcttcggctgttttagatgaaaaccaatcggcgaagctgtcgcttaaactgaaaaagtctgaaacgattcaagcctcagcgactgaaaacgagtctgcctctcaggccgcagaactgaaagtgatgatcaacggccagccgcactcggtccgacttgatgaattaggaaaagaagataaaaacggattctatcatgtcacagtgaaagtggaccctaaactgctgcaaaaaaaccgctacattgatattcagttcgtcacgaccggcttaaaggaaaacaacccttgcaacaccactgatgaggaaaagtgggtttttatcgataaaaacagtacattatcatacgccatcaaaggcatgtctccgtcagcggattttcaagagtggccgcttccttacgccggaaaccaggatcaaacaacattaatcgtgcttcctgacaccgtaagccaatcgaagcttgaggagctttctctcgtaacggaatcctttggcagcgaagcacagcattcatatacagtaaagaaatcatctgacgttacagcaaaggatgcgaaaggacgaaacctcattttcataggagggatcaatcaattttctcttctgaaggagaaatcatcagatctgcttgtgccgcaggagaagaacggctcgtttgatgtatctggtttcgagatgctgaatgagacgacaaaacaagtggtatttacccaagcatcggtttgggattcacgctatacaatggcagtctttgcaccgtcaaaaggagatggaacggctgtcacaaaagagatcatcagttatctgaacagcaacgatgagtcggcaaccgtccttaatgaaacaaacagccagcaggtgtttacaaaccaccagcagctcaaatcggaaacaaacagttccgatgcagaacaaccaacacaggatcatagccagaaatggatgtatattggtgtgctggcactcattatggtggttgcggcagtgttcatttggattgccgtaagacgcagaaaaagaaagacagatacagaataaaacagaggctattttagcctctgtttttttatttttggtaagtaaattccatttgtggaacctgtcattttatttttttctctcagccaataagcctctttacaacgtgcgggaacgggagtatgatctcttttagaaaacaaatcgcttaatctgaaatcagagcgggggacccaatagaacggctttttgccgttggggtgaatcctttttaggtagggctaactctcatatgcccgaatccgtcagctaacctcgtaagcgttcgtgagaggagatgaatgaaacctgtgttcgatgttatggcacaggggcatccgtttgcctctgtgttttttgttgttcatttttgaatgcaaatcgcatacagagacatcatagcagaaaggactatcatcaacatgtgagagcaagacactgatggatgttttattgttttaattgaaaaatgagaaattaaaaggggaagacatcgatgtatcattcaatcaaacgttttttgattgggaaaccactaaaatcccaagcagctggagagcaaaaactgacgaaattaaaagccttggctatgctttcctcagatgcgctatcatctgtcgcatatgggacagaacaaattctaatcattttggcaacaatcagtgctgccgcattttggtactccattccgattgcggtgggcgttctcatcttgctgctcgcactgattctttcatacaggcaaattatttacgcttatccgcagggcggcggggcgtatatcgtttctaaagaaaatctcggtgaaaaaccgggattgattgcgggcggttcattgcttgttgattatattttaacagtagcggtaagtatttccgcaggcacggacgccatcacgtcagcctttcctgtattgcatgattatcatgtgccgatcgctatttttctcgtgttagtgattatgattttgaacctgcgcgggctttcggaatcggcatccattcttgcctaccctgtttatctgtttgtggtggcgcttttggttctcattgcagtcgggttgtttaaacttatgacaggacaaatagaccagccagcccatcatacaccgctcggcacacctgtagccggcattacgctgtttttgctgcttaaggctttttcctccggctgctcagcgttgaccggggttgaggccatttctaatgcgattcctgcattcaaaaacccgcctgcgcgaaacgcggcaagaacgcttgcgatgatggggattttgctggcgattctgttttccggcatcacggtgctcgcgtacgggtatggtacggcgccgaagcctgatgaaacagtggtttcacaaattgcgtccgaaaccttcgggcggaatgtgttctactatgtcatccaaggtgtcacatcgcttattttggttcttgcggcaaatacgggattttcagccttcccgcagcttgccttcaacctggcgagagaccagtatatgccgcgaatgtttacagtcaggggcgaccgcctaggcttctcaaatgggattatctttttaggcgttgcttccattgtgctcatcctgttattcgggggacagacagagcacttaattccgttatatgctgtcggcgtatttattccatttacgctttcgcaaaccggcatgtgcatcaaatggatcaagcaaaaaccaaagggctggatcggaaaaatgctgatcaactcttgcggcgctttgatttcgtttatggttctgtcgatcctgtttgtgacgaagtttaatgttgtatggcctgttttaatctttatgcctatcgtcgttctgttgttttttgcgattaaaaatcactacaccgctgtcggcgaacagcttcgcatcgtagacaaagagccggaagaaatcaaaggcaccgttgtgattgtgcctgtggccggtgtcaccaccgtcgtacaaaaatcgattcactatgcgaaatcactgtccgatcaggtgatcgccgttcacgtgtcatttgacagagaacaggaaaagaaattcgaaaaacgctgggaagagcttaataacggcgtgcgtctcgttacgcttcactcctcgtatagaagccttgtccatccgtttgataagtttttggaaacagttgaggcgaaagcgaagaaggagcagttttccgttatggtgctgtttccgcaatttataacgaaaaaacgctggcacaccatccttcacaaccaatcagccttcctcctcagagtccggctgttctggaaaaaggacataatggttgccacactgccgtatcattttaaaaagtaaagctctaggaccaagggaatcaccttggtccttttttgcggaaaaaggaggtatggcggtgtatacacaaggtgcttttgtgatcgtactgaacgaaagtcagcaggttctgctggtgaaacgaaaagatgtccctttatgggatttgccgggcggcagggttgatcccggggaatcggctgaggaagcggcagtgcgggaggtattggaagaaacgggatacaatgcagcgctttctgcgaaaataggtgtttaccaaaggccaaagtttcaagatgaacagcatctgtttttcggaagcataacaggcggacaagcagtggctgacggcacagagacagcgggattaaagtgggtttccccggagcgtttgccgctttttatggtgccgaaccgaaaaaggcagatcaatgatttcaagaatggcgctcaagatgtaaatgtcaccgtcaaggatagagggttgctcgcggcgatcgacctgttgaaaagaagactgggcaagtgattcaggtctccgggttttaaagcctttctcctgtggtattgaaaaaaggaaaaaggaggatacgttatggcacacaaaactgcaggacaagcaatgacagagctgcttgagcaatggggagttgatcatgtatacggcatccccggagacagtataaatgagtttattgaagaattaagacacgaaagaaatcaactgaagttcattcaaactcgccacgaagaggtagcggcactggcagccgcagctgaagcaaaactcaccggcaagatcggagtctgtctgtcaatcgcagggccgggagcggtgcacttattaaatggtttatatgatgcaaaagcggacggcgcccctgtgctggcgattgcaggacaggtttcttctggcgaagtcggacgggactatttccaggagattaagctggagcaaatgtttgaggacgtggctgtgttcaacagagaggtacatagcgcagaatcacttccggatctcttaaatcaggcgatcaggaccgcctacagcaaaaaaggcgttgcggtattgagcgtgtcagatgatttgtttgcggagaaaatcaaacgggagcccgtgtatacttcaccggtgtatattgaagggaaccttgaaccgaaaaaagaacagctcgtcacctgcgcccaatatattaataacgctaagaagccgattatcctggcagggcagggaatgaaaaaggcgaaacgggagctcttagaatttgcggacaaagccgccgctccgatcgttgttacactcccggcaaagggtgttgttcccgataagcacccgcattttctcggcaacctcggtcagatcggaacaaagccggcttacgaggcaatggaggaatgtgatttattaatcatgctcggaacgtcattcccgtaccgtgattatttgccagatgacacgccggcgatacagctcgattcagacccggcaaaaatcgggccttgtctgcgattcggctctcggtctgcgcgaattgacagagtatattgaacgcaaggaagacagaagattcctaaatgcctgcacagaacatatgcagcattggtggaacgaaattgaaaaagatgagacagaggccacaacaccgcttaaacctcagcaggtcgtggcccgtcttcaggaagcggcagccgatgatgcggtgctctctgtcgatgtcggcactgtgacagtctggatggcgcgtcatttcaaaatgaacgcgaatcaggatttcatcgtctccagctggcttgcgacaatgggttgcggcctgccgggagcgatcgccgcaagcttgtccgaaccggaacgccaggcgatcgctgtctgtggtgacgggggattttccatggtcatgcaggatcttccgaccgctgtcaaatataagctcccgatcacagtcgtcattttaaacaacgaaaatcttggcatgattgagtacgagcagcaggtcaaaggcaatatcgactatgtcacaaaacttcaaaatgtcgactatgccgcatttgcagaaagctgcggagcaaagggcatcaaagtgactaaagcgggagagcttgcgccggcattccatgaggcgctgcaatctgaccaaccggtcgtagtggatgtcatgattggaaacgaaccgccgcttcctggcaaaatcacctacgggcaggcgaaaggctttagcaagtacatgctgaaaaacttcttcgaaaaccaaaaatttgaaatgccgtcactgaagaaaagtttgaaacggttattttagaggcccttttagaggcctctttttttgtgttggaaacaaatgtatttcaggttatccttgtattatattggtatgaggaggattacatgtttgagttcataaaattattgttgtatgtattaggatctgcaggaatgatctatgcgtcatatcacgattttcgccatgctcagaacgggcaaaaggacaaatgcatcttctttcaaagcaaaaagaccagcgcatttgtccttgtatgtttcatttgtttattcttatcaaatctaacagagctcttctcagtatagggttatttctcttttttcttcagcccgaagaagaaaggaaaagcagaaccgaccaagaaggtgccgaataaaaacatgccgccgataaacacgtggaaatttgtgtgtccggccgtaaacgccgtgattagggaaataatactgagcacgatcatggcaatgccgggcgcgactctcatttttcccttggatttatgggcagcaacagaacataaaatgccgataacaataggaacaatccacaaataaaacagaataaatactgacatcatcaaaactccgatttttcttctatcataacaaatttctgtcaaaaagggtatcaaagagcttttgcgaaaaaataaaaaccggctttagaagccggtttttttatcgaaacgtatctacaattaaaaacacattcaaagcaacgatcaatacagcaatcagccaagacaccactgtgacccatttggcgttgatcagagatcccatgatccgtttattgcttgtaaacataataagcggaatgagggcaaaggcgatcccgaaggacagcacgacctggctcagtacgagagcggtcgtcggattaacacctgacgcgatgatcaagatcggcggaatgatcgtgataaaacgccgtacatacagcggaatgcggtagttgataaatccttgcataatcacgtcgcctgaaagtgtgccgacagacgaactggatagaccggcaacgagcagcccgatcccgaataaagccgcagacatagggctgacaagatgtccgaattgctgaaatgcgacgtcgagatcctcaacaaacaggccgtttttgaagaataatgcggcagccacaatcagcatacttgcattaatagcccctgcaatcagcatcgctattaaaatatcaataaattcaaacctaaagatttttttccgttctgcatcagttttgccaaccacccgccgctgtgtaagggcagagtgtaaataaatggcgtgcggcataacagttgcgccaagaatacccgctgcaagaagcacactgtcggtgccatgaaacgccgggacaaaaaggcccttcatcactgacacggcatcaggctttgcgaaaaaggtctgcagcgcaaaggcgatcacgaccacaaacagcatgccggcaataccggcttcaagtgagcgataaccgcggcgctgaagctccaatatcgcgaaagaaccgatcgccgcaataatagacgcttcaagcatcggaatgccgaacagcaaatacagtcccagagccgctccgataaattccgccaggtcagttgcgataatgacaagctcgccctgaatccataatccgatcgagacaggcttcgggaattcttcacgggcaacctcaggcagatttttgcctgtcgcaataccgagtttggcggatagggattgaattaaaagggccatgatattagaaaataagatcacccataagagcatatatccgtatttagaacccgccgaaatattcgttgcgaagttgccgggatcaatataggcaatggctgctataaatgcagggccgagaaaagggagcagccctctgaatcctctgattttcccgtcaagcgcatcttggacggctttggaacggggagattgtgctgtgatgtccttgttcatcatgtctcacctgaattctgtttgtttttgccgtacaacaaagagtttccttaaggcaaattattttatctacatcatatgaccatcccggtttcttgtcaaccgaaaatgttcaaaatacacttctgaatttttccctgttatgtaacatgatatgtaggaattcgggataaggtcccatataaaaagacatcgtttcagttcgaaacgatgcctcctgtatctaatgagtctaggcttccttccgcagcccgcggaatataaggcccagcaagaacacgaagatggctgccccgatgatggccgggaaaatagcaaagccggcgaggctcggtccccatgtgccaagaagtccgtgcccaatccaagcgccgatcagcccggcaatcatagagccgaaaattcctcccggcagccggtttcctacaatggcgctcccaattaatccgataacaattgcaacaactaatgaaaccaaaaagctaagcatcatgatcacctctcataaatgatttaccaatcaataaccgctcctgatcatttcgaaacacttaaaagcatattcctttatgatcctgttttaatctttctctgcacactgccgtcagctaaatgaacaatgacctcagtgcctttatgcgccgcgatttcctttgcccgttcaatcgcttctttctttgtatctttgatttcagacacacgtttggcgccctcggctttgactgcccagccttttttatgcttaataacatgctctgctttattcatgagctcggggccgctgccgctgcttggatcagcatcgcgttctgtctcatcatcatgcgtcaggaaatcatcaatttcatctgtagaggcgttttccgcccattccttcgctttgcttgtcgcaattggaatcgcgcgcccttcctcatagccttcatcaatcatcgcattcgcaatgtctatcgccttttttctcaccggcttctcaagattttttaatgaagcaggataatccttcatcgaccaaggcatgtccatcactccttttccttttataaaaatggtacccgcaggtgaaaaataaaaacgcatccgaaaaaatgaaggtatactatatagtagaaaaaacggaagggaagtgcggattgggtgccaacagaacgaaaagaagacttacatcagcaattaaaagagatagagaaatgggaaaaagatcagcaaaaagtctggttttgggaaaagctcagccgtctcccgtttcaactcctggacaagctgacaccagaattcatccagaaaaagatcggcaagctcttggatgaggtcggcagctttgttcaaacaggcggacagtacctgacatctgaaaaacagattatcaggatatttcaaaagaaactgccggaggagatctttgaatcgctggaggacatccggaaggcgcctctttctgtcatggatgaaattgcggaaggaatgggcaaaaatagaaccaacgcagcaaccgttcaaggcgcgacaaccggtgtgggcggcgtgtttacgctggcggcagacattccggcagtgcttggcttatcactaaaaacattacaggatatcgcagtcgcatacggctatgacccaaaggagaaaaaagaacgagtcttcattgtgaaatgcctgcagcttacgtcggctgatgttgtcggcaaaagatcgattttgcaggaattaaaacactacgatcaagaccgtacatataagaatgtcgcttctcaaatccaaggctggcgagaagtcgttttgggctatcgagacacgtttggctggaaaaaacttttccagatggtgccggttgccggaatggtttttggcgccgctgccaatcgctcaacattaaacgacattaccgagacaggcatgatgctgtacaaaaagaggcgcattcttgaacgactgaaagaaacagaacgagagatggaatagcagaaagcagacggacaccgcgatccgcctgctttttttagtggaaacatacccaatgtgttttgtttgtttaaaagaattgtgagcgggaatacaacaaccaacaccaattaaaggaggaattcaaaatggcagacaataacaaaatgagcagagaagaagcaggtagaaaaggcggagaaacaacaagcaagaaccatgacaaagaattctatcaagagattggtcaaaaaggcggagaagccaccagcaaaaaccatgacaaagaattctatcaggaaatcggcgaaaaaggcggagaagccactagcaagaaccatgacaaagagttctatcaagaaatcggtgaaaaaggcggagaagccactagcgaaaatcatgacaaagaattctatcaagaaatcggccgaaaaggcggagaggcaacaagcaaaaatcatgataaagaattctaccaagaaattggctcaaaaggcggaaacgcccgcaacaacgactaatcaaaaacataaaggcagacaacctgtaaataaaaaagcgatccggcacatcagctggatcgcttttttttggaatcttctcaatttatgccactattgcgatacaataagtgaaaaaggggttttcgctaatgtccaagatgcaaaacttgctcgccatcgcaaatgaagtcaaagaaaagcacgccaatttttcaatctcagaggtcaacgaccactgcgtgcgccttgcggtgtttacgggagaatatgactggcaccatcaccctgactcagacgaattgtttattgttcttgaaggggagctgctgatcgattttaaggacaaagaaaccgcggtgctcaaagcaaatgacagcctgctgatcccgaaaggcacggttcaccgcacacgctcttacgtcagaacggtaaatctctgtgtggagcataaacaagccgaaaccgtcatcatagaggagcagccatgctaatcaaaaagatgatatgtgaagtagacgctgcaaacgctgaagcatttgcaaaagcgcagtcacagtgggaagcattatcgcatataagcggctttatcaaacaggccggcggctggcgaaaaacgatagacgagccgctcaccgcagaaatcatcagtgtatgggaaaacagagaagcctatgatcattttatggagaacgaacatgacagcatatacgaggaaaacgatcagaaggctgtaattctttcgatagaggtgacggtgtacgaagaggataaaccgttcgtttatgatctgttacataaccccgatatccggtacgaaccaaactggacggttctgaaggcataatcaaagcccaaaacatcatattttgggcttgtctctttactcgcgtcccggaagtgtattatgaacaaaaggcggtgctggttttaactccggtttttctccaaacgtttttgcttctttcacatattcaaaggcttctccgtccggcgctttttcattcagccagttttgctcggcgctttcttcgccttcagagaaattgataagctgatgtgagaactcttgtttttcgagcgctttcgggaatgtacccggcacaaccggaccttcctgtgcttctaattctttaatggcggcaagccattggttctggtgcattgtgtcacgcgccagcaggaagctgagcatatctttgacgcctttgtcatccgtcatttcaaacaggcgtgcgacctgcagacggccctgtgattctgcattcaggttggcgcggaagtctgccagcaggtttccgcttgctacgatataaccgccgctccaaggtacgcctgtactgctttccggcatggcgccaagtcctgatacaatcgcatggtgagggttcatgccgcctaggatggagccgatgaccggatcttcagcagctttttcctgctgatcaagaggggcattctcaagaagtctggcaatcatcgttgcgatcatttcaacatgcccgagctcctcagttgccgtatccatcagcaagtccttgtatttttcatttcctcttgtgttccagccttgaaataagtactgcatggcaactgaaatttctccgaattgcccgcctaaaatttcttgcatttttttagcgaataatggatctggacgatctggtttagcaggatgctgcagcatttttgtgtgcttaaacatgtacccatctcctttttcgattatctctttttatatttccgatcgatagaaagataaacgaaaaacagcgtatcgagatgggaactatgaatcttttcgcagctccaacagttcccggatcagctcccggccgaagatgggctcatactgccggtaaacagggtcaagacgcttcatccattcttgtttctctttatctgacagctcataaatatgtatagcagaattctttttgatttcttccagctgctccttgttcatttgttcggcatacgtttcattccactccgtcgtctccttcatcgcttcagtcaaaatgcgccttgtttctggtgtttgcgccttccagaagtgttcatcagtcatgacagcgtagccgagataaccgtggctgcttattgtcaaatagtcctgaacattataaaattttttagaatagatgtttgaaattgtattttcttcgccatcgactacattgttttctaacagctgaaaggtagaattgaaggattcctgatgaggtgttgcaccaagcagcttgaactgatcctcaatcacatcgctttgcataatgcgcagatgctgcccttttaaatcatccggtgttttgaccggcccttgatttgttgtgatttgcttaaagccgttcgtccaataggccagtccttttaattggtttttctttagagaatcaaacagctgtgtgccgatgcttccgttcagcccttttttggcggcgttgtaatctgtaaaagcatacggcagatcaagcactccccattcaggcgagagcatgccgagcttcgatgtggagggggcgataaattgaacatcgccgttttgcaatgcttcaatttcttcaatgtccgagtacaggcttccattgggaaatacttctatttttattttcccgcctgatttttcgttcaccagatcagcgaatttattggcggcaagcccttttggcgtattttcagcaaccacgtggctgaatttaaacacgatttgatcctgcaggccttcctggtcgtcatcataaacaatctttttattgcctgtatgatcatggaatccgataaataaagcggttgcaattccagcgatcatcagtgcgagacatgcaagcaaactcttcatgaaaagccctcccctatgttaaggataatgggggcaatgacattcgtaaagacctgaaaggagaagctgatgaacaaaaagaagctctcaatccgttggaaaatcacgatcttatcctatatactcgtcattttctcctttttgatcggcggcattgtgctcatcggcaacattcagcatacagaggagcgggagctgaaaaagcggctgatgaatacggcccggacggtgtcagagatgacagaagtgaaagaagccttggcgcgaaaaaaacaaacagaagctgttcgccatgcggttgaagaaatcaggatgattaatgaagcagactatattgtcgtcatggatatgaatcacatccgatatacgcatcctgtcagcacaagcatcggcaagaaatcagaaggtgcagacgaggaggcagcgtttgcggagcacatttatttctctgaagcaaagggcgagctcggcacggcggttcgcgctttttatccggttaaggatcaagacctgaaccaaataggcgtggtgcttgtcggaaaaacgctgccagggatcgctgacatcctgcttcatttaaagcgtgatatcgccttcatcgttgtgctgacactcggctttggccttgctggttcctttttgctggcccgccatatcaaaaaacaaatgtttcagcttgaaccccatgagattgtccgaatgtatgaagaacggacagcgacgtttcactcgatgaatgaaggggtgatcgctattgacaatcggctcgtcattacgatttttaatgaaaaagcgaaacagatctttgaagtgcagggggatctgatcggcaaggtgatttgggaggttctcaaggattcgcgcctgcctgaaatcgtggagcggaacaaagcggtttataatgaagaaattcgtgtcagcggaaaagtcatcatgagcagcagaattccgatcgtcatgaagaaaaaagtgatcggcgccgttgcgatttttcaggacagaacggaagcggccaagatggcagaggaattgactggtgtcagaaactttgtggaggcgctccgtgtccaaaaccatgagcatatgaataagctgcacacgatcgccggcctcatccagctggggaaatctgaaaaagccttgcagcttgcattccaggcgtcaactgagcaggaaaatgtgactgaatttctgcaccgctcgattcaaaatgacgctgcggcaggccttctattaagtaaaatcagaaggggaagagagctcggcattgctgttcatatagatgaaaacagcagtcttcagcaatttcccgagcatgttgatcagcatgatattgtcgtgcttttggggaatctgattgaaaatgccttcggctcatttgaaaccgttcaatctgaagacaaacgaattgacattagtatcgaacaaacagatgatatccttgctattttaatagaagataacggctgcggaattgatccggcacatatgcctcgcctttacgacaaaggttttacggtcaataaaactggcggcacaggctatggcctgtatctagtgaaacaaatcatagacaaaggatcgggcacgatagaagttgattcacatgcggggcaggggacatctttttctatcgtttttccaatgaagggggaggaagcacagcatggctcgtaaagaatggaaggttctgctcattgaagacgatccgatggttcaagaggtcaataaggatttcattacaactgttaaaggcgttactgtctgtgcaacggcaggaaacggagaggaaggcatgaagctgatcaaagaagaacagccggatctcgtcattctcgatgtgtacatgccgaaaaaagacggcatcaagaccttgcaggagatcagaaagcaaaagcttgaagtggatgtcattgtcgtctccgctgcaaaagacaaggaaacgatctcactcatgctgcaaaacggggcgattgactatatcttaaagccgtttaagcttgagcgaatgagacaggcgctcgaaaagtacaagcaatataaacaaaaaatcgaagcgaatgatacgctgtcccaggaacagctcgatgcgatcctgaatattccgcagcaggccgtacaggatctgccgaaagggttgaatcacttcacgatgaatgaagtcactgcttttttgaaacagcaaaccgcatccctttctgctgaagaggtcgccaaggcgcttggcatcgccagagtgacagccagacgatatcttgattacttagaaaaaaccgggatcatcaaattggacgttcaatacggcggagtcggccggccggtcaaccgctacgtgttaaaaggataaacctgagaccaaaaagaccaaaatgtccgttatgatcataaacttccccagacattatgaaaacgctatcattatagtaagaaagacacaaaaggcgaataggacagggggatgaaggatatgaaactgtttaaaaatttaacagttcaggtcataaccgcggtcatcatcggggtcattgtcgggctggtctggccggatgtcggcaaagaaatgaaaccgcttggcgatacatttatcaacgctgttaaaatggtgattgcaccaattattttcttcacaatcgttctcgggattgcaaaaatgggcgatatgaagaaggttggaaaagtagggggaaaagcgtttatctatttcgaggttgtcaccaccctcgcactcattatcggtttatttgtcgtcaatattatgaagccgggtgcgggtcttgattacagcaagcttgaaaagggtgatgtatcacaatacacgcaaaatggcggtcagggaatcgactggattgaatttgttacacacattgttccatccaacatggttgatgccttcgcaaaaggggacattttgcaggtcttattcttttctattcttttcggagtgggtcttgcggcattaggcgaaaaaggaaaaagcgtcattgatttcttcgacaaggtttctcacgtttttttcaaaattatcggctacattatgcgtgccgcgccaatcggggcattcggggcgatggcgtatacaatcggacacttcgggctcgattccatcaaaccgctggcaagcttaatgatgtctgtttatattacgatgttcctgttcgtatttgttgctttaaatatcatctgcaagctttacggattcagcctgtggaattaccttcgcttcattaaggatgagcttctgatcgtgcttggcacaagctcttccgaatcggtgcttcctcgtatgatggataaaatggagcgctacggctgttccaaatccgttgtcgggctagttattccgacgggctattcgtttaacctcgacggcacatccatctatttatcaatggcgactgtctttttggcacaggtgtttggggtagacctcagcatcggccagcaaattacgattatcctcgttctgatgctgacatcgaagggagcggcaggtgtgacgggaagcggatttatcgtccttgcctcaacgctgtcagcgctgcaggtcatcccgctggagggtcttgcactcctgctaggggttgaccgattcatgagtgaaggaagagccattgtgaacctgatcggaaacggaatcgccacgatcattgttgccaaaagcgaaaatgaatttgatgaagcaaaaagcgtagaggctgtggaaggcatgaaaaaaatgaaaacagcagtctgaaaaaagaacggcccatccatggggccgtttttttaattgtttaagaattattaaggtaaggacagagacctcagcatttttttgttatataatttacaaatggatactatattgaatgaaggacgtttgtcctaacaggagtgtataaatggccgctttagttaaattttttcagcacccgggagtaaggcgtttctccatctttgtcgtgttaactggtgtgttatatctatttaagagcatgatcaacttaatattgcttaccttcattttcacatttctaatggatcgtttggagcttgtcgtgcggcagtttgtaagccagttcttccgcgtgagccagcgggttgtcattacgtttctttacatgttgctggctgtgctgcttacagtcgggggctttgtgttttatccggtcgtcgcggcacagatccagcagctggtaaagcagattaaacatattgcgtatcatcctgacagcatccctttctttgatgagatcaccagtgtcttcggagatattaacatcagttcatatgtcaaagagggcttcaatgtagtgtatacgtatctggccgatatcagcacattcggcttgcaggtcgtgatggcgctcattctcagcatgtttttcttatttgagaaaaaacggctttctgaattcatggcgaaatttaaaacgagcaaactgagggtcttttatgaggagattgcttttttcggaagcaaatttgcaagaacgttcggcaaggtgctcgaggctcaatttatcattgcgctcgtcaactgtattctgacgtttatcgcgctttggattatgcattttccgcagctgtttgggctgtcgattatggtgttcttccttggattgatccctgtagcaggcgtcgtcatttccctgattccgctcagcattatcgcctacagcactggcggtggaatgtatgtgctctacattgttcttgtcatattcgccattcatgcgatcgaaacctatttcttaaatccgaagctgatgtcggcgaaaacagagttgccaatctttttcaccttcacagtactcattttctctgaacacttcttcggcatttggggtttaattatcgggattccgatctttgtgtttctccttgatattctggatgtcaccaacaaggaagataggtctaaaggtccccgagagaatagcgataaaaagtagtttaaaatcgaataatgagtgtgcctcgatctgccggcctgcctgttcagggcatggaattaagactcggaatcggagtttggcattgcttcgcacagtggtgaacacaacaggtgacaatgcctgtcatcattacagaaactgaaaagaacaaacagtcggagcaaacgctcatcatcggtttaaccaaacatttggaagcaacaaatgctataatacaaacagtgcctaatgttgggcactgtttattttttgtcgaaaaaggaggaaggctttatggctgagccgattttacatattgaaggcctcgataaaaagattgggtctaaacagattttaaaacagatcagcatggacgttatggagggcgaaatcatcggcctgctcggtccaaatggttccgggaaaacaacactcatccgtatcatcgtcgggctgctgaaacaaaacagcggaagcgtgacaatcagcggattccagcatgatacagagtttgaaaaagcgatggaagcggttggagcaattgttgagaaccctgagttctatccgtacctgacaggctgggaaaacctcaagcactttgcgaatatgcacaaaaaaatagcggatggacggcttgatgaagtggtagaacgtgtcgggctgacgtcagcgattcatgataaggtgaaaacctattcccttgggatgcgccagcgtctgggaatcgcccaggcaattcttcaccggccgaagcttctcattctagatgaaccgacaaacggactcgatcctgcggggatgaaggattttcgcaatcatgttaaggaactcgcagaaatggaaggaacagctgtcctgttcgccactcatttattgcgcgaggttgaagacttgtgcgaccgtgtcatcatcattcaaaaaggtgagatcaaagcggaagtcagcttacaaggaactgatcaaaccacagaaaaagcaattatagaagtgcagccgcaagaaaaagcgctcaattggcttacaggcaatcaatatcaagctgagagccaagacgggacgattgtagttgaggtggcaaaagaaaacataccggagctgaaccgatcacttgtcggacaagatctgaatgtattttccattacgccttacacgcagtcactggaagacgaatttataaaagcgacaacagctcatcaagaggagggagaagagcttgtctaaattaatttggaatgaacatatgaaactttttaatcggaaggtcactttggtttctcttatcctgatggctgtctttcaattcttcatggcattgatcattaaacggattgtcatcagtgccggaacagatgaaaacttcatcggctatttatcgtatacaccgagcctgaacattttgctgcaggctttaacgatcgtaattgcagcaacaattgtttcgatggaatttgataaaaagacgatcaaatttttgctcattcgtccggttaaacgccaaaaggtcttttggtcaaaattaatcacagtcgtgatggtcagcttctatttgtatctggcatactacattctcgcattattattcggtctcgtgttttttggcacatcggtgactgcggaatcaaagacattgctggtcaacaccttggcgctgatcgggtcaaactggcttgaagctgtaatgatgggattattcgggctgctttgttcttcgctgttccgcaacagcgcggtagcagttgttgtttcttttgtcgttttatacggagcgagtacacttgttcagctcatgaagttgtttgaaaacaagtggggcagctttttgctttttgcgaacactgactttacgcaatacagaagcggagagacagcgttgttttcaggcatgacgccattgttttcaattggaattctcatcatacatgccatattcttcatcgttgttggctggtggtgcttctgtaaacgggatgttcgggtctaaaggcaaggaatgacatttttgtgaaaaagctcacgtaaatcaatatcatttgatattttggtttatactaaaggtactgacggaggtgtctcgattgaggaactttattaccgctttaccgatcatattgctgcttggattctcatttgtgtctttcatgtttcagtttgaacatcttgtttatttcaggctcgcgcttgggttgttttctctcgtgggactgtacatgatatataaaatgaagacgggcatccgctattttatcatctatctgtatgccagctggattgtgttggccgcagtgaccgcttttgaagagccgattttctcaagctttttctttggcggcctggtgatgaccatgggttacctgacatatatgctgatttatctcggcatgaaacaagaccgggatgcaaatcctgtgtaatcgcgctgttcccttggggaacggcgtgtttttctatactgggcaaaaggttaacagttgcggaaaaatggcagggaatctataatacatattaaatttatcggaattaaaactggggggctgccggatgtcattatttatacaaaacgatcaacagcggcaatggatggagaaaatcggacggattgcggatgaatttcagcaaacagctgctgaagatgacgaacagggacgttttcctgcagagaaaatacaaaaactgcgtgatgctgggtatacagcattaacattgccggcatctcatggcggagggggcatttctgtttacgatatgctcctgtttcaagaacggcttgcacggggagatgcttcgacggctcttagcatcggctggcatttgagcgtgatcggggagcttggagaaggcaacagctgggatgaagacgtatttgcatttgttgccaaggaagtccaaaacggagccgtcattaacagggcggcgactgaagcgaaaaccggaagcccgacaagaggagggcgtccgggtacacacgccgtcaaaaaggatggcaaatgggcagtgaacgggagaaaaacctttacgacgatgtcacaagctctggattattttttagtaaccgcatggattgaagacaaacaaacaacaggcgtgtttctcattcataaagatgatcccggcttgtcgattgaagagacgtgggatatgatggcgatgcgggcgactgggagccatgaccttgtactgaacgaagtaatgcttgatgagaataagctggtggaactgcttcaagggcctcgtggagctaagccgaatggctggctgcttcacattcctgcgatttatcttggtgtggctcaagctgctcgtgactatgcagtgcaatttgcatctgagtattctccaaacagcttgaatggaccgatcaagaatgtcccggccgtacagcaaagaacaggcgaaatggagcttgaactgctcaatgccagacactttcttttccatatcgctcaattgtatgacgatccggagcggcgtccacacttgaccagcgagctcggtgcggcgaaacatatcgtcacaaacgctgcgctgtctgttgttgataaagcgatgagaattgtcggggccaaaagcctgggacgaaccaacccgcttcagcgctattaccgtgatgtgcgcgccggtcttcacaacccgccgatggatgacgccgtgatacacaagctggcagctgaagcgtttgagtcataaaaaaaagagccttaccggctctttttatgtattgttttgctcttgcagatttttttgatgcttgcggtcaattctgtcataaataacgttcatcagctttggattgcccataatcgcctctttgttttcctggatcagctgttggtaagttttcactttacgcttcggcatgctccggcgccctcctgacatgtttgtattcactttctaactccgtcagcgacaattcatacagatgacgctttgactttttgtatataccattctgtattaacagatgaatgagctgtttttttctgatttctgcagactgaggtgtcattgtgtcaccaacctccaatcaaacgatattgataatcattatcaattaacttcagtatacaatgtccgcaatagcctgtaaagatgaaaagagtcctattctttctccaatttacaaacattcaacaaatcgacaaaaagtttcccgggcaataatttgctgtcgaaatattccgcttcattgaacgcaccctgctatttttcatgttttgaaccatactatgtaatagaatggaggctggtattcaatggagcggacagaaaatctgaaaaagggagaaaaaggggcgctcctcaatatttttgcatatgtcatccttgctgttgtaaagctagttatcgggattctatatcattctgaagcgctgagagcagacgggttaaataatggaacagatattgttgcgtcagtagcagtgctgataggattgcggatttctcaaagaccggctgacagcgatcatccatacggccattatcgggctgaaacaatttcgtctcttgttgcgtcttttattatgatggcagtcggcattgaagtgttaatcggcggaggaaaagcgattgcgggcggcacaacggaaacgccaaatcttatcgcggcatggacggcgttaggcagtgctgtgtttatgtatggcatctatttatataacaaaaggctggcagcgtccattaaaagctctgccctgatggcagcggcaaaggacagcaggtcagacgcttttgtaagtgccggcgcgtttatcggtgttttttcgtcccagctgaagctgccgtggattgatccggtaacggcttttatcatcggcatcatcatttgcaaaactgcgtgggatatctttaaagacgcttcacattccttaacagacggcttccatttaaaagatcttgagccttacaaacagaccgtcggcaggatcgaaaatgtgcatcgcctaaaggatgtgaaagcgaggtatttaggcagtacagttcatatcgagatggtgattacggttgatccgaagcttacagtagaagaaggccatggagtggcggatgaagtagaagacaaaataaaacatgaacacgatgtcactcatgttcatgttcatgtagagcctgacgacataaaataaggctgtttaacgaattagcttatatgttcagataaaaattcagtcacttcttcaggcgttttggcattggcgctgtgaaggtgagctgttttttcaccgttcttgaaaataagcaggctgggaatgcccattacttggtatttttcagccaggtcaggaagctcgtccttattcagctcataccaatcgttttgattgtattcttccaaaatatcgccgatgaacatattcatgcgtgtgcagtctgggcaccaatcagcataaaactttacaatgatttctttatcggattgaatcagttcattaaattgttcgtttgttgtgatttttttcatatgtcacatctccttttcaatgccattttaatataaaataaaaaggaattacatacaaatgcattcaacatcagcatgcccaaaaataattagatcattttccggtgaaaatgataagatagtaaagatgaattgtagtgggggagtatccattgaaaacaagtctaggattagtgtacggaggaaagtcggcagaacataatgtttccctgcagacggctctggctgtaatcaaagcgctaaatactgagaagtttgatatacatccgatttatataacagaaaaaggcgaatgggtaagaggcgctcgtttaactgagcctgtttcaaatgtgaaaatgcttcaatttgagcaaggaggcagtgctttttctccagctgccctgaaccaggagatgtttccgcaggaagcgtcacagcaaaatgaagccatcgacgtcgtattcccgctcctccacggaccgaacggagaagacggtacgatccagggaatgctcgagctgttgaacattccttatgtcggcaacggagtgcttgcttcctcagccggcatggataaagttgtcatgaaacatttatttgctcaggccggccttgctcaggctaaatacgcagctttccttaagaaagactggactcgttctccgaaagaaagctgtgagcaggttgaacaggaattaggctacccttgcttcgtaaaaccggcgaacctcggctcaagtgtcggaatcagcaaatgccgaaaccgtgaagaactgcaaaaagcgtttgagcttgctttccaatatgaccgcaaagtcgtcgtcgaagaaggcattaacggccgcgagatcgaaatcggcgttcttggaaatgacgatcctaaatgctctgttgtgggggaaatcgcaccgaagacggatttctacgattacaaagcgaaatatgaggatggagatactgatctgatgattccggcgattgtgactgatgaggaatacgcaacaatcagtgatatggcgatcaaagcatttaaagcgatcgacggttcaggactcgtcagagcggactttttcctgacagctgacggcgaagttctgatcaatgaagtcaacacaatgcctggctttacacctttcagcatgttcccgctgctctggaaagaagccggagtggaatatgctgacctgattgaacagcttgtggagcttgcaaaagaacgccacgctgaaaaacaattgattaagcatacattctaatgaagaaggacactgccggtaaaagggcagtgttttttcccgtatatacaaaagaaagagagggaccttacttgattaagcgaacagtaaaaaacattgccgaaatggttaatggcacactaacaaatccgcaatatgaacaaacagtcattcatggagtggcaaccgatacaagaaaactggaacaacatcagctcttcattccgctgaaaggggaacgttttgacggccacacttttgtggagcaggcttttgaagctggtgtagcggctgttctttgggatcggtcagaaccaaatccgcccgagaatcacgccgtcattttagtggacgatacccttactgcacttcagcagcttgcaaaagcctatttgcaggagcttggcacgcgtgtcatcggagtaaccggaagcaatggcaaaacgacaacaaaagatatgattcacgccgtattggggacccagtaccgtgtccacaaaactgggggaaacttcaataatcatatcggtttgccgctgacggttttagcgatgcctgaaaatacggagatcgccgtattggagatgggaatgagcgccaaaggagaaattgacctcttgagccgactggcaaacccggatgcggcagtgattacgaatatcggcgaatcgcatatgcaagaccttggctctagagagggcatcgcggaggcgaagcttgaaatcattaacgggcttaaagaagacggagtgctgatttatatcggggacgaaccgcttcttcaaaatgcatacagctgccagacgaaaacgtacggtacgggagcgcataatgattatcagcttcaggatgtcagccagagtgaggaaggaacccattttacaatcaaagggataaaaaacacgttttttattccaatactcggcaagcacaatgtgatgaacgccatggcagcgattgctgcaggagcttattttggcatcacgcctgagggtgcggcaaaaggactgagcggcctaaaggtaaccgggatgagacttgaactcatcaaaacagacagcggcctttcgataatcaatgacgcttataatgcgagcccgacttccatgaaagctgcaattcaattgacagaaagcctcgaaggctacggcaaaaaaatgctcgtgctcggtgatatgcttgaactcggcgatcttgaagaaacgttccataaagagtgcggcgctgtgatcagccctgataaaattgaccgcgtctttacgtacggaaaactgggagcttttatcgcggaaggcgccctgaaacactttgagaaagaccgcgtcagccattacactgagaaaaaagatctcctccaagctgtgaaggaaaacgcatcaaaaggcgatttgattttattcaaagcgtccagaggtatgaagcttgaagaaatcgttaaagatttaatagagagcccgctttcgtaagaaaatattttgcgaaaaaacgcatattgcatcataaaataacatgatgtgcaaacactaatgtatgccggccgaaaattatgtatatctggccggctgcggctatgatacaatatatataggttatttcgcgatacgaacatattcgtccggacttttcatcgtgacccgaagttctccgctggattcttgggagcggatggagcagcagccggcatattcgagatgccgatctgcttctcatcttattgaaaaacaaatagtgtaatggtaagataaaacttaaagtaattcgggctttgtatacggatggatcctgtccttcttgtctaaagggcagttttataagtggtaaatcacgacattactgaaacagcaattagaaggagtttgaataatttgactataacgtttcaagattttaatttaagttctgatctcatgaaagcaattaatcgtatgggatttgaagaagcaacaccgattcaggcacaaacgataccgctcggactttcaaataaagacgtcattggacaagcgcaaacaggtacaggtaaaacagctgcgtttggtataccccttgttgaaaaaattaaccccgagtctcctaatattcaagcaatcgtaatcgcgccaacccgtgaattagccattcaagtatctgaagaattgtataaaatcggacaagataaacgtgcgaaggttcttcctatttacggcggacaggatattggacggcaaatccgggcgttaaagaagaatccgaatattattgtcggaacacctggacgtcttcttgaccacatcaaccgccgcaccattcgtttaaacaatgtaaatactgttgtaatggatgaagcggatgaaatgttgaacatgggattcattgatgatattgaatctatcctttcaaacgtgccaagcgagcatcagacacttctgttctctgccacaatgcctgcgccgatcaaacgcattgcagagcgctttatgactgagccggaacacgtaaaagtaaaagcgaaagaaatgacggtttctaacattcagcagttctatttggaagtgcaagaacgcaaaaaattcgatacactgactcgccttcttgacattcagtctcctgagcttgcgatcgtattcggacgtacaaaacgccgtgtcgatgagctggctgaagccctgaaccttcgcggatatgcagctgaaggtattcacggtgacttaacgcaggcgaaacgtatggttgcgcttcgtaaatttaaagaaggcgcaatcgaagttctagtcgcaactgatgttgccgctcgcggacttgatatctcaggtgttacacacgtatacaacttcgacgtgcctcaagatcctgaaagctacgttcaccgtatcggaagaacgggccgtgcaggaaaaacaggtatggcgatgacgttcattacaccgcgtgagaaaagcatgcttcgcgcaattgaacaaacaacaaaacgcaaaatggaccgcatgaaggagcctacacttgatgaagcgttagaaggccagcagcaggttactgttgaacgtcttcgcacgacaatcagtgaaaacaacctgaacttctacatgacagcggcagctgagctgcttgaagatcatgatgcagtaacagtggttgcggcggctatcaaaatggctacaaaagagccagacgacacaccggttcgcttaacagacgaagcgccgatggtcagcaaacgctacaagaaccagcgctcttctaaacgcagagacggtcaaggcggcggctaccgcggcggaaaagggaaaagcaacaaccgttcttcctatgacaaaaagcgttcaaacgatcgccgttcttcaggtgacagacgccagaaaaaatcttactaatttgatcgattcagagcccaaaacatgatgttttgggcttttttatgttcgcgatttgttattcagcaaattttcagctgacggaagccatttttctctgtatgcttaagaatgaaacctttctgtaaaagagacgtataaataacgacgaaaaaaagggaggtaggtatttttgagagagcagccaaaaaaccaaatcagtccagacggattaaaggtttggcgacttcaagagatcatcatatccgctgtttgcttacttattgtcattgcagttgcagtgttaagctattattttcattggccgtactggatcagcggcgtgctcggcgcggtttggctgttgggatcgattgtgacggtctttatcattccgaaggtccgtcataaggtgtggcgatatgaagtccatgaacatgaaatagatattcagtcaggtatttttgtggtaacacgtgtgattgttccgatggtcagagttcagcacgtcgatacgtcacaagggccattattaaaaaaatacaacctggcaacggtgaaaatttccacggccgcgaccgttcattcgatccccgctttagagatggaggaagcggatcggctgagagactccatttcccgtctggcgagggtgactgacgatgatgtctgaaccgaaacgcctgcacccggcagcagtcattttgaatttatgccataccattattcaaacgataaaaaatatcattctgccattcttttttgtgtatattgtcaattcaaaccatactgtccgtttttacggagccattgcgctcggtgtgctattcatctggcttgtagcggcaagcattatcaaatggagaaggtttacctatcgaattgaagatgatgaatttagaatcgaagaaggcttatttgttacgaaaaagcgatacatatcgattgatcggattcaaacgatgaatacgagcgcaggccttgtccagcaaatctttaagcttgtgaagctgcaaattgaaacagcaggcggaggcaaggaggcagaagccgttctttctgctatttctgttgaagaagcggaacgcatcaaagaagctgtctttaagaaaaaagcgcaaagacgagaaaatgaacttgatgaagaacggcttgaagctgaagaggagttggttccggccgttgaggtgcaagagcactatcgcatgaacgcgaaagaattgctcatggccgcttctacctccggcggaatcggagtcattatctccgctgtatttgcacttatttcccagcttgatgaagtgctgccaatggattggttattcgataagttttccttccttcagcacgccagcatcggtatttacgcggtactgatttttatcggtttatttatcgcctggattttcagcatcgcgggcatgatgtttagatacgcgaactttcaaatcataaaaaaagagcaggaactggtgatttcaaggggaattattgaaaaacatcaagtcacgattccattgcgaaaaatacaagccattaaaatcaaagaaaatatcattcgccagcttttcggctttgtaacggtgtccatcgtcagcgcaggaggcggcgaccgggaaaaagaagaaggcgctttgaccattctctttccaatgattcataaaaaaaagcttccgcacatgctccgaacatttacgccggaatacacgctggaagaaaactgccgccgcctgccgcggcgcgcgttgaaacgctatttgttccgttctgtcattttttcactatttttgatcatcccgttatgtatcttctttcagccatggggctatctgtcagccatcctgctgccgatagaattgttcttcggctatctcgcgtataaagaggctgcatggacgatcaacggggaccgtcttcagctgacgtctagatttataggcagaacaaccgccattgtactgaaaaaacgaatgcaggtctgcaagttcagccaatcctatttccaaaagaaaggccgcttgtataccatttctacttcggtgaaatcatcgagccatatggaagaattaacggtgagggatgtaggtgaagaggatgcagccttcattttaaactggtactcatatgaaaaagcggacggttaataccgccgctcttttttttgcacgcataaaaacgaaagaagaaacccgccgcatagtccaaacagatgggccatcatgttaatattggagttgataaacgacatgagaacggcaaatgcgagcagtgtgatgatcattttggaatgctcctgccctattagttcattgcgaaaaagaaccataaacaggtacacgccgaatagcccgaaaattgcgcctgaagcaccgacatgcacgtaatcaagcggctctgtaacataagtgccgatattgccgatgatgccggagccggcgtatacaagaagaaaacgcgcttttcccagcatgcgttccaaagccggggcaaataaaaagatggacatggaattaaacagcagatgtgtgaaaccggcgtgcagcaaaatcggtgtgatcagccgccaccattcaccgtttgcgacacctagattatagcctgtgacggtatccctccataacacaactgaatgggcaggaagtgaaaaaaacagccagagaacagcttgcaaagccaatataaaggtgacaacggggtaaagcctgataaatgtttgaaaattttcagtccgtataaacattccgagccccttttcttcattttggtatatctatagtaacacgtttatgagacaaaccatttaaatagtacgtacgcaaaggaggttatcatacatgatttacggcattgggctggacattaccgagcttaaacggatcgcctctatggctggacgccagaaaaggtttgccgagcggattttgacgcgaagcgagcttgaccaatactatgagctttcagagaaaagaaaaatcgaatttctcgcgggcagattcgcggcaaaagaagctttctcgaaagcgtttggcaccggcattgggaggcagctcagctttcaggacattgaaattaggaaagaccaaaatggcaagccctatatcatttgcacgaaactgagccaggccgccgttcacgtatcgatcactcatacaaaagaatacgctgccgcgcaggttgtgattgaaaggttgtcaagctagtctgcatattagggaaaccccactcatatatttgatagtgcattaagggagacaagttgtttgaggcttttatggtacgcatctgttctgcctaaacgtgtaccgagcgtaccgttaaagtcaaacaagcgatttcttccttttacatcaattgagaaaaaggggttgaaaaaggtgagaaaaagctttgttttgcttttaacgggactgcttgctgttcttattctttctgcctgcgggcaaaaaacacagcaagatattgtggccgggttagatgaaaaggcgaaagaatacacctcgtacaaagcaaaagcgaaaatgaccatcgagacagggagtgagcctcaagtatacaatgtggaaatctggcacaaaaagccgtctctgtacagggtttatttagaaaatccgaaaaaggaccaaaatcaagtcattttacgaaatgaaaacggagtattcgttctcacgccgtctttaaataagagcttcagatttcaaagcgattggccgaacaacagcagccaggtttatctgtttgaatcgctcgtaaaggatgttcaaaacgattcggatgcagttttcacagcgaaagaaaagaaatacgtattcgaaacaaaaacaaactatcagcataacaaaatgctgccgacgcaagaaatcacatttaacaaaaaagatatgagcccgtcatctgtcaaagtgatggataccgaccggaaagtgatggtcaaagtagaattcagcagctttgaatttaataaacaatttgataaagaatcatttgatgaaaagaaaaatatgaccctttctcaaatggatgtcgccacaagcgcgaagccttccgatacatttgcggtcaaaacgccgctggaactgccgcttggcgtcaagctgcttgaagaaaaagatatatctactgaagacgggaagcgcatcatcatgacgtacggaggagaaaaatcatttacgttaattcaggaaaaagcccagattgccaaggcttcctcctccgttacgctgaacggcgaaccggtaaatctcggctacaccatcggcgccttgtcggatgcatcattgtcatggacatatgaaggcgtagattaccttctctcttctaaagatctttctaaagaggaaatggtgacagtagcaaaaagcatgcagggacaatcatcgaaataacaacaaaggccaaacatgatttggcctttttttcgttagacatcgtttccctttagcctttaattttagtatgatatgtaaatgatattgaataaaagctaggaagtgtcgtaatgagcacaaaacctttttacagagatacgtgggcggaaattgacttgtccgcgataaaggaaaatgtcagcaatatgaaaaaacatatcggtgaacatgtccacctgatggcagttgtgaaagcaaacgcctacgggcatggtgatgcagaaacagcaaaggctgctcttgacgcaggtgcttcatgcttggccgtggctattttggatgaagcgatttcactgcgcaaaaagggcttgaaggcgcctatattggtgcttggcgcggttcccccagagtatgtggcaatcgctgctgagtatgacgtgaccttaacaggttattctgttgaatggcttcaggaggcagcccgccacacgaaaaaaggttctcttcattttcatctgaaggtcgatacggggatgaacaggcttggtgtaaaaacagaggaagaagttcagaacgtgatggccattcttgaccgtaaccctcgtttaaagtgcaaaggggtatttacccattttgcgacagcggatgaaaaagaaagaggctatttcttaatgcagtttgagcgttttaaagagctgattgctccgctgccgttaaagaatctgatggtccactgcgcgaacagcgccgccggactccggctgaaaaaaggcttttttaatgcagtcagattcggcatcggcatgtatggccttcgcccgtctgctgatatttcggacgagataccgtttcagctgcgtccggcatttaccctgcattcgacgctgtcgcatgtcaaactgatcagaaaaggcgagagcgtcagctacggagccgagtacacagcagaaaaagacacatggatcgggacggtgcctgtaggctatgcggacggctggctccgaaaattgaaagggactgacatccttgtgaagggaaaacgcttgaaaattgccggcagaatttgcatggaccaatttatggtggagctggatcaggaatatccgccgggcacaaaagtcacattaataggccggcagggggatgaatatatttccatggatgagattgcaggaaggctcgaaaccattaactatgaggtggcctgtacaataagttcccgtgttccccgtatgtttttggaaaatgggagtataatggaagtaagaaatcctttattgcaggtaaatacaagcaattaacttacctaaatggagaattcataaaacagctttgcttgaagagtgaataatggtatcattatcactggatggataaaagagtcgtatccgtaagtttggtggaggtgtatgttttttgtctgaatccagcgcaagaaccgaaatgaaaatcagcttgcccgaaaacctagtagctgaattggatggtgtagcgatgcgggagaaacgaagcagaaacgaactgatatcacaagcagtgagagcgtatgtcagcgaacgaacaactcgtcacaaccgtgatttgatgagacgcggctatatggaaatggcgaaaatcaacctgaatatttcttctgaggctcactttgcggagtgcgaggctgaaacgacagttgagcgcttagtcagcggaggataatcatttgattgtgaaacgcggcgatgtttattttgctgatttatctcctgttgttggctcagagcaaggcggggtgcgcccggttttagtgatccaaaatgacatcggaaatcgcttcagcccaactgctattgttgcagccataacagcacaaatacagaaagcgaaattaccaacccacgtcgaaatcgatgcaaaacgctacggttttgaaagagattccgttattttgctggagcaaattcggacgattgacaagcaaaggttaacggataagattactcatctggatgatgaaatgatggataaggttgatgaagccttacaaatcagtttggcactcattgatttttagacatatttgcaggttgctcaaatagagcaactttttttgttttcaaaaaacataaacgatataatagtgaaataacgaaaaaatatgttgttttttattgggaggtaagcgaatttgatgtcgaaccagactgtataccagttcattgccgaaaatcaaaatgaactgctccaactgtggactgacacactaaaagaattaagcgagcaagaatcctatcagctgactgaccaagtgtatgaaaatatatctaaagaatatatcgacattctgttgctgtctgttaaggacgaaaatgctgctgaaagccaaatcagcgaactggcgcttcgagcggtccaaatcggactgtctatgaagtttttggctactgcgtttgctgaattctggaagcgtctctacacgaaaatgaatgataagagattgccagatcaagagagcacggaattaatctggcagattgaccgctttttcagcccgattaacacagaaatttttaatcaatactcaatctcatgggaaaaaacagtatctctgcaaaaaatcgcgctgcaagagctgtctgcgccgcttatcccggtgtttgaaaatatcactgtgatgcctcttgtcggaacaattgataccgaacgcgcgaaacgaattatggaaaaccttcttaatggcgtcgtcaaacaccgttcccaagtcgtgctgattgacattacaggtgtccctgtcgtcgatacgatggttgcccatcatattattcaggcatcagaagctgtaaggcttgtcggagcaaaatgcctgctggccggaatccgcccggaaattgctcaaaccatcgtcaatttggggattgatttatcccaagttataactaagaataccctgcaaaaaggaattcaaacagcattggaaatgacggatcgaaaaatcgtttcattgggggaataacattttgagacatccgaaaatcccgatcttgaaactgtataattgcttattagtgtccattcagtgggaacttgatgaccaaacagcattaacctttcaagaagacttattaaataaaatatacgaaacaggtgctaacggagtcgtcattgacctgacatctgtggatatgattgattcatttatcgcgaaagtgctgggcgacgtcattacaatgtctaagttaatgggggctaaagtcgtcttgaccggcattcagcctgctgtggcagtgacgctgattgaacttggaatcgcacttgaggaaatcgaaactgcgctcgacttagagcaggggcttgagacattgaagcgggaattgggggaatagcgaatgaacgaccaatcctgtgtaagaatcatgacagaatgggatattgtggccgccagacagctgggacgaaacgttgcgaaagaactgggtttcggcacggtagaccaggctagaattacaacggctatttcagaattagccaggaatatttatttatatgccggcaaagggcagattggaattgaacaggtcgcagacagaggaaaaaaaggcctgaaaattatagcggaagaccaagggccgggaattcctgatatccgaaaagtcatggaagacgggttttcaacgtctggaggacttggtgcgggacttcccggggtcaaaaggctgatggatgaattcagcttaaattccgtagcgggggaaggaacagagatacaagccatcaaatggcttcggtaggaggtaagaacgtggattttagggaggttattgagcagcggtatcatcagctgcttagtcgatatatagccgaattaacagaaacatctttatatcaagcccaaaaattcagccgaaaaacaatcgagcaccaaattcctccggaagaaatcatcagcgttcacagaaaagtgctgaaggagctgtatccaagtctcccggaagatgtgtttcattcgctggattttttaatagaagtcatgattggctatggaatggcttatcaggagcatcaaacccttagagggatacagcaggaaatcaaatcagaaattgaaatcgcggcaaatgtccagcagacgcttctcggaactaaagttcctcaggaggaagcgctggatatcggcgccatcagtgttcccgctaaacagatgagcggtgattactaccactttgtcaaagacaaggaatccatcaatatcgcaatcgcggacgtgatcggaaaaggcattccagcggctttatgcatgtccatgattaaatacgcaatggactctttgccggaaacgggcatacacccttctcaagtgctgaaaaatttgaatcgtgttgttgaacaaaacgttgatgccagtatgtttattacgatgttttatgcgaattacaatatggacaagcatcaatttacatatgcttcagcgggacatgaaccgggattctattattctcaaaaagacaacacgttttacgatttagaggccaaaggactcgttctcggcatctcgcaggactatgactacaaacaattcgatcagcatctggaaaagggcgatatgattgttttattttctgacggcgtcacagaatgcagaacggaaaacggtttcttggagcgtcctgatctgcagaagctcattgaggaacatatgtgttcctccgcgcaggaaatggtcaaaaacatttatgacagcctcctcaaattgcaggattttcagcttcacgatgattttacgttaattgttttgcggagaaaggtttaacgtctgtcagacgagggtataaagcaactagtgatttgaaggaaaatttgaggtgatacgaatgaatataaatgttgatgtgaagcaaaacgagaatgatatacaagtaaacattgcaggagaaattgatgtatactcagccccggtgcttagagagaagctcgttcctctggcagaacaaggagctgacttaagaatttgcctgaaagatgtcagctacatggacagtaccggattgggcgtttttgtagggacctttaaaatggtgaaaaaacaaggcggttcgctgaaacttgaaaatctttctgaacggctgatccgactgtttgacattacaggcttgaaggacatcattgatatttctgcaaagtcagaaggtggagtgcaatgaagaataatgctgattacatcgaaatgaaagtgccggcccaacctgaatatgtgggaattataagactgacgctgtcaggggtcgcaagcagaatgggctatacgtacgatgaaattgaagacttgaaaatcgcagtcagtgaggcgtgcacaaatgcggttcagcacgcttacaaagaagataaaaatggggaagtgtcaatacgattcggtgtgtttgaagaccgtttagaggttattgtggcggatgaaggagacagctttgactttgatcaaaagcagcaggatctagggccgtacacaccttcgcacacagttgatcaattatcagaaggagggctcggtctatatttaatggaaacgctcatggatgaagtcagagtgcaaaaccactccggcgtcaccgtagcgatgacaaagtatttaaatggggagcgagttgatcatgacacaaccatcaaaaactacgaaactaactaaagatgaagtcgatcggctcataagcgattaccaaacaaagcaagatgaacaagcgcaggaaacgcttgtgcgggtgtatacaaatctggttgacatgcttgcgaaaaaatactcaaaaggcaaaagcttccacgaggatctccgccaggtcggcatgatcgggctgctaggcgcgattaagcgatacgatcctgttgtcggcaaatcgtttgaagcttttgcaatcccgacaatcatcggtgaaattaaacgtttcctcagagataaaacatggagcgttcatgtgccgagacgaattaaagaactcggtccaagaatcaaaatggcggttgatcagctgaccactgaaacacaaagatcgccgaaagtcgaagagattgccgaattcctcgatgtttctgaagaagaggttcttgaaacgatggaaatgggcaaaagctatcaagccttatccgttgaccacagcattgaagcggattcggacggaagcactgtcacgattcttgatatcgtcggatcacaggaggacggatatgagcgggtcaaccagcaattgatgctgcaaagcgtgcttcatgtcctttcagaccgtgagaaacaaatcatagaccttacgtatattcaaaacaaaagccaaaaagaaactggggacattctcggtatatctcaaatgcacgtctcgcgcttgcaacgcaaagctgtgaagaagctcagagaggccttgattgaagatccctcgatggagttaatgtaatgatccaggttgaagaaaacgagcatattcaaactctagtatatcaactgaataaagaagggaaatcgatttgcggtgacagtttttttatgaaagctgatgataaggagttaatttgcgcggttgctgacggactgggaagtggatcacttgctaacgaatcctctgcagccatcaaagacttagtggaaaactatgcgagtgaagacgtagaaagcattatcgaacgctgtaatcaggcgatgaaaaacaaaagaggcgctacagcatctatcctgaaaatcaattttgagcaaaggcagtttacgtactgctctgtcggaaatgtacggtttattctgcattccccgtctggtgaaagcttttatcctctgccgatttcgggctatttatcaggcaagccgcaaaaatacaaaacgcacaccgccacctatgaaaagggttcaaagttcattatacatacagatggactcaacgtacctgatatccgctcccatttaaaaaaaggccaatcggtagaagaaatatcgaattcgctgaaaatgtatacgacatcgagaaaagatgacctgacctatattctcggacagctgtcctagagaataagaacaagaagaagccggaatgccggcttctttttttatgtgtttttttcggtttttgatacactagagacagaacgacaaaattggaggctttggttacatggaaacgtcagcccttttaaaacagcaaattgcgaaagaaataggtttatcacaaaaacacgttgaaagtgtcatccgcctgcttgaggacggcaatacagtcccgtttattgcccggtatcgaaaagagcagacgggttcaatggatgaggttcagattcagacgatttctgaacgctggcaatacatacaaaacctgaatcagcgaaaagaagaagtcatcaggctgatcgcagagcaggataaactgacagatgatctaaaacgtaaaatcgagcaatcggtgaagcttcaggaagtggaagacctttaccgcccttataaacaaaaacgtaaaacaaaggcgacagtcgccaaaagcaaaggccttgagccgcttgccgactatatcctgacacttccccaagatgatcgtctggcagcaactgcagaccaatacatcagcgaagaaaaagaagtgtttacgcgagaagaagcgattgaaggcgccaagcacattattgcggaacaaatttcagacgagccgaccttcagaaagtggattcgccaggaaaccttcaaaagaggaaccattaagtctgcagcaggaaagtcggcagacaccgatgagaaaaatgtgtatgaaatgtattacgagtatgaagagccaattgcaaaagtcgttccgcatagggtgctggcaatgaaccgcggcgaaaaagaagacattttaaaggtagcgattgaaccgcctgcggatcacattaaggcgtatttagaaaaacaagtcatcaaaaatcgctcaacatccgtaagagagattttgcaggagacaattgatgacagctataaaaggctgatccagccggcaatcgagcgtgaaatcaggaaagagctctcagaaaaagctgatgaacaggcgattcatattttctcagagaacttgagaaaacttcttttgcagccgccgatgaaaggcaaaaccgttctcggtgttgacccagcctttcgaaccggctgtaagctcgctgtgtcagatgagactggaaaagtcttgaaaattgatgtgatctatccgcatgcgccagtcaacaaaacaaaagaagcccatgaaaaagtgaaaaagattcttgagcagtatcaagtcgagatggtggcgatcggaaacggcacagcatccagagaaacagaacaattcatcgtcaatgtactgaaagacatgccgcgcaaaatttattatgtgatcgtcaatgaagcgggtgcaagcgtctattcggcttcagagctggcccgagaagaattccctgaccttaaggttgaagagcgcagtgccgtgtctattgcgcgaagacttcaagacccgctcgcggagctcgttaaaatcgatccgaagtctgttggtgtcggacagtatcagcatgacgtcagccaaaaacgcttaaatgaatctctgcggtttgtcgtcgaaacggtcgtaaaccaggtgggagtaaacgtcaacacagcctccgtcgcgctgcttcagtatgtagcgggattatcgaagtctgtagcaggcaacgttgtcaaaaaacgtgaggaaatcggaaagttttcaaatcgaaaagaactgaaggacatcccaaggttaggtgcgaaaacctacgagcaatgtatcggtttcttaagagtgcaggaagggacagagcctttggatagaacaggcatccacccggaaagctataaagaaacaaaagcacttttgaaaaaactcggactttcaacagaacatatcggcacggcggaattgaaggacaaaatcaatcagctggcgctctctgaaacggcaaaagagctgggaatcggcgaaatcactctgaaagacatttgtgaacagctgacaaggccggaacgcgatccgcgcgatgaggtgcctaagcctttgctgaaaacagacgtccttcagctggaagatttgaaagagggaatggaactgcagggcaccgtgcgcaatgtagtggacttcggagcgtttgttgatatcggagtcaaacaagacgggcttgtgcatatctcaaaattgagcaatcaattcgtcaagcatcctcttgatgtcgtatctgtcggcgatattgtgacagtttgggttgacggcgtagatgtacaaaaaggcagagtatcgctgtctatggtaaaataaaagcactgcttacgagcagtgttttttcctatagaaataccagcattgattcagcagtttaatttggtaattatctttttcaaggaacgctttttgcatctgctttttaagccaatttggcataggctcattcctcctcagcttttatcataagagggacggtgattaccatattgtatgcgaacggtgaattgtcccgttcaatgttttttaagtgaggtgcgctatggataatatagagcttcaaaagctgacagaggatatttctaaaacatattttaaaaagccgttccgccatcaggcgctttttaatgacaggcttaaaaccacgggcggaaggtacctgttaacctctcataacattgaattgaacagaaaatatctgattgaacacggcagggaggagctgatcggcatcatcaagcacgagctctgccattatcatctccaccttgaaggaaaagggtacaagcacagagacagagattttagaatgctattgcagcaggtcaacgcgccgaggttctgtacaccccttaagaaaaaagcggaaaacaaaaaaacttatatgtatatctgtacggcctgcggccaacagtatataaagaagcgcgccatgaaccctgacagatacagatgcggaaaatgccgcggaaaaataaaaagaattttttcgtgaaaaaggttgacgaatatggcaagcctatgttacattataaaagtcgtcacgagagataaataaaaacatttacctcttgacactgcaaatcaaggctgatataataagtcttgtctcattattccacagtagctcagtggtagagctatcggctgttaaccgatcggtcgcaggttcgaatcctgcctgtggagccatattggagaagtactcaagtggctgaagaggcgcccctgctaagggtgtaggtcgcgtaagcggcgcgagggttcaaatccctccttctccgccataagatttcgatataagttctcaaccatcggcccgttggtcaagcggttaagacaccgccctttcacggcggtaacacgggttcgaatcccgtacgggtcattccatttcgttgggctatagccaagcggtaaggcaacggactttgactccgtcatgcgttggttcgaatccagctagcccagccattttttattttttgaaatctaatagtaagagccattagctcagttggtagagcatctgacttttaatcagagggtcgaaggttcgagtccttcatggctcaccatttgtatttttgcgggtgtggcggaattggcagacgcgctagacttaggatctagtgtcttacgacgtgggggttcgagtcccttcacccgcactttatttacaaagtgcacgcaaatcggttttactaggttaagagcctactaaaccagcacaaacacaatttaatgatcacgcggtcgtggcggaatggcagacgcgctaggttgagggcctagtgggtgaataacccgtggaggttcaagtcctctcggccgcatcaatgataccaagggtttagagtaccttggtattttttgtatcttttgaacagaaggtattttgtgattaaaactgaccacttacctaaagtaagtggtttgatttgtccgcaaaagtatatagttaaataagataaaaaggacatagtatatcagcatacaaaatatgttatgcctttttttgttttaataacgcatccgttattttcagcgtacaatgttactttattatggaataaaaacaagtgtctgtaagcttgcttccatctgcggataaatcatcatttcttaaagtgccttcgaatacaaacccaagtttttctggaatagcacgacttttaaggtttgttgattcacatcttatttcaattcttctaaatttaatattgtttaacccaaaatcagctaatttttttactgcttctgtcatatatccattcccgccaaatttagtatttacccagtacccaatttcacatttaggaatggtccagtcaatcctctgaaggctagttattccaataaagttattgctagctttatcaaaaataagaaaacgaaaactttccctctttaaaaaatttatatgagcatttcttaaatttatctctgtttcttcaacagtaggaagttcttgagcaaatggcaaccaggcttttaattcattaaaggaacccctaattgcttggtttacaattttcccgtctcctgtttggtgtggtgctcgaaggattagtctttctgtttccaattgtaaaggcacatctaacaataaaggattcatttgatttctcctctcggaattttatattaaagaagcaaagtaatacaaaataaagctttatgacgtgcgcaaatttagttcaatttgcgtttaatcttctaaaagatattttcgtaactgacatcatatacctattgtgagaaagtcgatgataagtatcatgagatggaaggtatgccaataaacggtgaaaatgatcgtcttggcttatcaaagaaaacaccagactatgaagaagcaaaagatgaagagacaaagttaggagtaaaacgtgtgtttactcctcttttttaattcttgggttcattttcctcattctgggtgttcgattgggtgctcttttttcggtgaatttttttcctgtcaacatctccatttgacgtctagctctggccatttcagtaggaagaatgtaaatatattcaagtatcttatttgtaaatttaaataaaggctcaaccatagtactgttaaattctatatcatcaccatgagcagctgcattccctgcctctttaatcatcttagaaagaccgcccattaaaggtggtaaaattttcttttcctctaagtcgttaagttttgcatgaagcgttcttccaatagcccctttatttttacataccatttccaaagttcttctaagagccattaggcacaccatagcatcaattttccttacatttaaagctgactcataagcagatttaatgtttttaggtaagaggtttaaattcacctgttcactatatgggaacaaaacttgaccatctttataaatatcatcaccctcgttgtatacttcttcagtattccaatgagtatgatacagttgaaattcaaaacaaacaggacactcgaacacttcaaatatgtcattaaattgggcttcataagaggttaatggtacaaatgtttttttttcatatctgtttaacaaattcataggtgccttagttccacaatgtgggcaagtgagaattgtattttctgtcattttatctccctcaatagatttttcctcgtattataacactcttgtttaaattgttaaaatttatcactaatgatttaatagttagcaaatttatatgaaatctaaggaaatagaagatctcaataatgcttatgagactataaaagaaattgagaagcaagggcaattaactggcatgttggaatactatttttacttttttaagggtatgtacgagtttaggcgtaaagaattaatttcgtgataagtgcttattgaatagctgaatcaaagttgtcagaagttgaggatgaaatagagaaagcagagttttttttcaaagtgtcctatgtatattattatatgaaacaaacatacttctccatgaattatgcaaatcgtgcactcaaaatatttagagagtatgaagagtatgctgtccagactgtacgttgtcaatttattgtagcaggaaacctaatcgattctttggaatatgaaagagccttggaacaatttttaaactctttggaaattttcaaggaaagtaacattgagcatttaattgcaatgtcacacatgaatattgggatttgttatgatgaattgaaagaatataaaaaggcttcacaacatttaaacttggctttgcaaatttttgaaaaatcaaaacatagttttctaacaaagactttattcactttaacctatgtggaagcaaaacaacaaaattatgacgttgctttgacatactttaggaaaggacgatttattgtcgataaaagtgatgacaaagaatactcagcgaaattcaaaatattagaggggttatttttttcagatggcgagactcaattaataaagaatgcattttcatatctggcttcgagaaaaatgtttgctgatgttgaaaatttttcgattgaagtcgctgattattttcatgaacaaggaaatttaatgctctctaatgaatattatcgtataagtattgaagcaagacgaaaaattaaaaaaggggagatcattaatgaaaatcaaccggattctattggcagcagtgatattaggtagtgttttatcatttggacattttattgatcaggatgttaaggcatcaatacaagtagcttctgatagagttggggcataattagataagaaagagtgaggttgaataatatactcactcttttattgattaaagtaatactcctaataatattatttcccttgatgtgctaaaattaagttatattggtacttttcatcatcattataagcttaaaaaatatggtattaatctaacagtgaaagaggaatgtaaaaatgaaagaggctaatgatcattatcctagttacggggcaaataaatttgtgtgtccaacatgtatggtgtattcacaacaaaagtggtatgagattcaaaaaaatgatatggataacgaattaattctcacagagcatttaagaacaagagggcgtgtgcctgcttatgcaagtccaaataaagaagctagtgttatacatgctatacctcaatttcacaccgataacataactgctctaagtgtgtgtatcagttgtgatcaaccggcttactggattgatggagaattagtttaccctaaaaatccaactgtgaaacctccaaattccgacatgccggaagaagtgaaaaaactttataatgaagcgagagaaataagtgtactatcacctagagcttcggcagcattacttagattagcattagaaaaattattacctttattaggtgcacaagggaagagaataaacgatatgataggtgacctagtacagaagggactttcgccgaaaatacaacaggctttagatagcttacgtgtaattggaaatgaagccgttcacccaggttcaattgatttagatgaagaaaaagaggttgcattagcgctatttaagttaataaatttagttgtagaacaaatgataaccgaaagcgatgaaatagatgagatttatagtctaattcctaaggataaacgagatgggatacaaaatagggatcaaatgaaaacaacaaaataagctaaaaaaatgaacataccacaacgatgttggtatgtttgtttattgaaagaacattcatgaataagttgaggtcataggaaaagtgtttttcttcttaaagaagtgcccattttctgcccagaattaataataaattatcaaaatcagtgtaaataatataactcgatgctatgaataatggcttttgtaaatgaagatatgattttgctaggttgagggactcgaattaaaaaagaagataccaaactatattggtatcttctttttttttgcatcagagttattaaatctttttatattgctgatgttaaattaatgtcccatttttacactaacgatgtgacttatatgataattatatacaaaaatcacttatatctagaaaattaaacaaatttacacaaaaaaggacaaaataatctttacaaattacgacaaatacttgatgttttttgtaatcaacccttattttgtgacaaatatatgaatattttgtcaccctgtaaaatatttatttattatatatatttaattcgagaggaggtcatataaagaacgaatattcgaattagtatgaatttaccgggagatagattcataaaacaattaaataatgggagtgggagtctatgagaaagggctttgtgcctaaagcttacatactgaatcttaggaaaaccctaatgatttttgcagtcttgttattgattgctggcaatgtgttgacagttttgccgaatcatattcatgctgaagataatacagaggtaactcaaagtgcagatactacttgcccagctcctgttgcgttgattaacggaagctttgaacaaggtgctgcaagaggatctgcatatgataaatccggactctattatctcgaatccgaggtacctggctggaaaacgactgatgattcctctggtcagaaggcaattgaaatatggaactatgcacagaatattccggctgttgtgaaaaattggccagcacctccggatggcaatcgctgggctgaattaaacgcttttgaaaatggcatgttgtatcaagacgtgaaaacaacgcctggacaaacgatttattggcgcttatctcatatgggacggcaaggtgttgacaccatgcaggttcgtattggggcagctactagcaatccatacagtacggtggttcaaaaacaattctctgatggaagaactgcatggggaactcatacaggttcttatactgttcaagcaggccaaacgacaacgcgattcggttttgaagctgtaagtacagcgtctggaaatataggagccggcaactttttggatgatattttccttggaacagaaccatgtgtgacggcaaataagtcagtttcaccacagggagaggtacaacccggggatgagcttacatacgcggttcaaatcaaaaatgaaggcggagacgttgctgctgatgcaagcttttcagatgcaattccagagggaactgaatatgttcctggatcattaaaattaattaacggttcgacaacaaagaatttaactgatgcagcagatggtgatgaaggcaattttgatggtaataaagtaaatgttgcattaggagatctacctaacacgaccaacttgcctaatggaatgactgtacagtttaaagtgaaagctaagacaggttatgtcggcaaagaaatttctaacaaagcgcaaataaactatgacagtctattaacgaatgcaagtaaaaaaactgaatcaaacgaagtaacgactccggttgtttttaaagatcctgtacttgaatcaaagaaaacatctgctattaaggcaaaagcggatggaaaccaagacgtggatcacccagaagttggagatacgctttcttacacgattcaaacacgaaatacaattgaagacagtcaggtgaaaaacgttaccatttcagatgcggtgccagaaggcttagaatatgttccgggctctttacaagtagatggcacatcagtcagtgatgctcatgatgatgataaggggcagtatgctgatgggaaagtatcaggacaggttggtaatataagcgataccaaatggcataatgtgacttttgaagcgaaagtgaagtccggtcaagcaggaaaggatattatcaataaggcaagcatttcaggagataatattgaaactccggatacaccgagtaatgaagtcaaagtttatccgaggaatcctgccttagagtctaagaaaacatcagcaattaaggaaaaagtggcaggaaacaagtatccggatcacccggaagtaggagacacgcttctttacacaatccaaacacgaaatactgaagaagacagtgaggctaaaaatcttacgatctcagatgctctaccaaaaggactggaatatgttccaggcactctgaaagtagacggtacagcagtcagtgacgccaaagacgatgacaaaggtgatgtgacagacggtaaagtgtcaggccaaattggtgatgtgactgatactgaatggcataatgtgacctttgaagcgaaagtaaaggccggacaagctggtgaaacaattcaaaatacggctagcgttactggaagcaacgtcgacacaccagataagccgagcaatgataccgagatttatccaagaaagccaaatgtagaatcgaagaaaactgcaagcctacaggaaaaagcagagggcaataaagatgagaaacatccagaagtaggagatacacttctttatacaatcgaaacgagaaacacaattgaagacagtctgctgaaagatctcgtcatttcagatgaacttccggacggattagaatacgtttcgggctcactcaaagtagacaataaaggagtcagtgacgccaaagacgacgataaaggtgatgtgacagatggcaaagtgtcaggtcaaattggtgatgtgactgacacagaatggcatactgttacctttgaagcgaaagtgaaagctggccaagctggtgaaacaattcaaaatacggctagcgttactggaagcaacgtcgacaccccggatactccaaaaaatgaagttgaagtttatccgaggaatcctgccttagagtcaaagaaaactgcaagtattcaagcaaaagcagagggcaataaagaagagaatcagacacaagtgggagatacacttctttatacgatccagacaagaaacacaattgaggatagtctggtgaaaaatcttgtcatctcagatgaacttccagaaggcctagagtatgtttctggaacgctaaaagtagacaataaagccgtcagcgacgcccaagatgatgataaaggcgctatgacagacggcaaagtatcgggtcaaattggtgatgtgactgatacagaatggcatactgtaacctttgaagtgaaagtgaaagctggccaaagagatcagaaaattgtgaataccgccagcgtcacaggtgacaatgttgataaaccagatacaccaagccatgaggtcaaagtttacccgaaaaatccagtcttagagtcagagaagacagcaaagaatctggattccgataaagagaagtatgaagcaggagatacgattgtttacacgatcaaaacaagaaatacagtagcagacagtaaagtaactgatctcgtcatctcagataaactgccggaaggcttagaatatgttccaggcacactcaaagtagacaataaagaagtcagtgatgcccgagatgatgataaaggcgatgtgacagacggcaaagtatcaggccagtttggcgatgtgactgatacagaatggcatactgttacatttgaagcgaaagtaaaagctggtcaagcagacaaaaaaattgtcaatacggcgagcattagcggtgataatactgataaaccggatacaccaagccaagaggtcaaggtttctccgaaagatccagttctgaagtcggaaaagtcagtaaaaaatctcgattcagataaagggaaatatgaagcgggagatacagttgtttacacgattaaaacaagaaatacagtagctgatagtaaagtaactgatcttgtcatctcagataaacttccagccggattgaagtatgtcgaaggcagcttgaaagcgagcaacggtggagaagcaaccatcaaggacggcaaaatcacagctaactttggtgacgtgactgataccgagtggcgtagtgtgacattccaagcgaaaattgagtccggatatgcggaaaaaacaattaaaaacgtggcaaccgttgacggcggcaatatcgacacaccagatacaccgggaacagacatgaaagttgatcctaaggaaccaaaactagaatcaaagaaaacagcctccattaaggaaaaagctgatggaaataaagatgaggaccatccggaatctggcgacacgcttctttacacaatccaaacccggaacacggttgatgacagccttgtcaaagatcttgtcatctcggattctcttccggaaggattagaatatgttacaggaacattgaaagtggatggtacagcagtaagtgatgatcaagacgatgatcatggatattatgccgatggtaagacgtcaggagagtttggcaatgtgaccgatacgaaatggcactctgtaacatttgaagcaaaactgaagtctggtcaagcaggtaaagatatcgtcaacactgcaaacatcagcagtgacaatatcaagacccctgacaaaccgagccatgaagtgaaggtatatccgcgaaatcctgttttagaatctgaaaaaacagtgaagaacttggattcagataaggaaaagtatgaagcaggggatacggtagtctacaccattaaaacccgaaatacagtatccgacggtaaagtagaaaacctggtgatttcagatgatcttccagccggattgaagtatgtcgaaggcagcttgaaagcgagcaacggcggagaagcaacaatcaaggatggcaagattactgctaactttggtgatgtcactgatactgagtggcatactgtgacattccaagcgaaaattgagtctggatatgaaggcaaaaccattacaaacgtggcaactgtaaatggcagcagtattgataagcctgataaaccgaaagcagagatgaatgttgtatcgaaaggttccgagaaaccaaatgaacctgctaagccaagcaaaccaacgtcagagccaagcaaaccaacacccgaaaaaacagatggaaagacaaatacaggaaaagaacttccaaatacagcaacaaatacgtataatctgatccttgttggtttggtattgttagtagcaggaactgcactttggtactttagaagaaaaagaaatgcctgatgttgcatgaagaaatatcttcctatattcatcattattgccggactcgtttttacaggttacggagtctggaaagtgatggacatcagtcataaaacagaacaaactttagatgaggcaaaacttgcattaaagagtccttctggaaaaaatgaaggctcagataaagaaggatttaagcctaagttcggagaggcagttggcattctggagattcctaaaattaacgcagagcttccgatagtagagggaaccgatgcggatgatctggaaaaaggagtcggccattacaaaggaagctattatccagatgaaaacggacaaattgttctatcaggccatcgggataccgtcttccgccgaacaggagaactaaaaaaaggtgatcaattaaaggtgaagctgccatatggaagtttttcatatgagatagacaaaacaaagattgtagaccaaaaagatacgtctattattacgctgcagcataacaaagaggagctaattctaacaacttgttacccattttcatatatcggtaatgcaccaaagcggtatattatttatggaaaacggatttgagaaatccagaatatcaaagattaggctgacgaattttcgtcagcttttttaatcatgttctttctgcattctggttcatgttaaatcatagtaatctaggttaatataaaagtattttgtatatttttataagtttactttacttttttataaggtgagtttataatttggttcaagaggtgatggtcatgaagaaagattttggtgattcgatctcaaataaggtttatgaatatcgtgtacttgccagattgtctcagcaagaattagcaaagaaagtcggggtttccaaacaaaccatctttgtaatggagaaaggaaattatgttccgactctgctgttagcttttcgaattgccgaattttttaatgtggatgtaaacgagatttttacttatgagaaaggaaatgatcaaaaatgaaaatgaattcgatcacagatacgatcaccaacgcaattttttcccctttaaagtcctgggctgaacattctccgggaaattggaatattcttattggcagtgggtttgtattgcttgtagtcggattgattctgacattcgtatttactaaaaaaatgggtaagactgacgaaagaacaaaccaaatcgctttaaatggtagcctctgtacgttatgtgcactaattttttgcgacttgcttttcccaaaagaatatatgtggcaagttttcttcttatttaagtattctattgcattcttcgcttcagcaatctatctagccgttcgatataaaaaagattttttgtaaattcaattaccgagaaagatagtgtctctgtagttgtaattgttttaggagagggaacgaatatgaaatcatttaataatgaaatttggagatgtgggaaagtatgggggttttttgctcgccaattattaaccacaattcatacaaaccgttagagatgatgtaaaatgtaatgaaaataagctttcataaccagtgctatggattgactatgttgagggcctagtggggtgaataacccgtaaaggttcaagttctctcggccgcacccccaataataccaagggtttaaccatctttggcgttattcttttgcggaaaatacggcaacaaatgtaccgcattgtggagtccactaaaaaagtgctgacctctgcacaacatcgttgcgcgagtctgcacttttattctgcgattatggggagtttattttaatccgttgttagccgcgccgatacttggcttttagaagctttttttaagtggctaaaaccaacaaattttttgccttcttcatcccataggcggaactttaacgatttaaggcttgttgccagtgtaatggtcggaacgttttgcaatggtttagtgttgttatgcactttttcaagcttatagtttgggactctcgggcttaaatgatgaacatgatgaaaaccgatattgcctgttagccactgcatgacttttggaagcttataaaaagagcttccttcaactgctgcttttacatattcccaatgctcatcttcttcaaaataagaatcctcaaacgtatgctgaatataaaacatccaaattccgagagagcctgatatcataaaaatcggcacctgaaccagcaggaagttttgccagccaatagcccaacataaaagtgctgccaaagcgacgatccccaggttcgttacatacgtattcatccgttctttgcgttttgccccttttcgattaaaacgattggcaatcccgaaaacgtaaatcggcccaataataaacataacaaacggatttctgtacaatcggtacattatttttgtcttagttgaggctttcttatattcctcaaccgtcagtacccaaatatcgcctgtaccgcgtttgtccagattgctgcttgtcgcatgatggacagaatggtcgtgtgcccaatgatcaaaaggatgcagagtcagaattcctgttaatgttccaaggattcgattcgcctttctgttcttaaaaaaggaatagtggcagcaatcatgaaagatgatgaaggttctcactaaaaaacctgccgcaacaacagaaatcgctaatgtaaggaaataagaaatcgacaagctcttatatgccaaacaccataataggaaaaatggtaccaatgtgttaatgatttgacaaatgcttttgtgtaaatcggacttttcataaggtgtaaccagttttctcaaagtccttaggttttgttctttcatattaaaaagtttccccttccctggtgatcttctaagtgtagaaaacgttttatagccttagaaggcccaacgtgatacaccccatatatgataagtatccttcccgattcatctgtgaaattattggaaatgataaactgatttccagtttattattagcagagtcagccgggatacaaaaggcgtatgaagattatacccagcactttattgggtcaaactctctcaatgctcccccatggggatcgatttatttgaccgtgaacattgattgtttgaggaaaaaaggaatgaagtaatgggtatatccatgagtgactgtttggaaacatctgcagaaacaaagttttacaagtgaacagccttgtttttaaaagattatcttgctctttaacaagaaacagctgagctaagtactattaagcaaagaaaaaggtttgaagacactcgtgattcatttttcatggtgttttcaaaccaaagtttttaataggcctcttattctgcactggtatacacatgtttaacaaataatgccatgaataaatcggaaatataatttgcagttatttccgattcctgatataataaagaagaattatttttgttcggtgtaaaggatagtatgaagattgacttttcgtcttgatgatactttgggcaaggatagtatatactgtgtggttacacactaggaggcaacaaaaatggaacaaggtacagttaaatggtttaatgcagaaaaaggttttggttttatcgaacgcgaaaatggagacgatgtattcgtacacttttctgcaatccaaagtgacggattcaaatctttagacgaaggtcaaaaagtatcgttcgacgttgagcaaggtgctcgtggagctcaagctgctaacgttcaaaaagcttaatcttcaatcgtttatacaaacaggctctttatatagggcctgtttttttatgtctatatcatactcaataaaaaaccctactcaacgttcgagtagggagatgctacaaggtatagaaaaagatttaaaacttcaaaggtttgtttacagtataacatactggattgacaatatgcggaatgtatataaattatttaatgttttgttcaaatataactctttcttttttcacgttcgttactttaagtaagattagatgaattataaaaatggtttcatctaaatgttatcaactcgcatatctcttttatgagaagaagataaacaattattattcaatgtggcagtggatataagaaattcttaaaaataatgaggagatcgattgtttttttctcctggaaataatcacttagagatacctaaaacaatgaaagccctacctctcttccatccttacggctccttgtccgtgccagtgtgaatcaggatactaaaaaaagtgactattttattgagttttttggtaaaacttcaatcttcgcagaagaaatgtaaataataaaaatggattagaatgtaggaataacaaaagaggtcgttaatgttctaaacataagttggagaagatttgcttttcatcataatattccgaaatatcttttgggatgtatctaaccaaaactttttatttgtttttcagtgattcctttaattacttccagttcactaatcaaaaattcatatgcattatccagcatttttttttcgcttgcattaagtgctttttctttcttcatacgcattaaatcacgtacaacttcagcaccttcttgtatttcacctgtttttattttgtccgtgtttattttgtacctttgcttccatggcagtaacctatcggattctccatgctgaaaaatgtgcataatgtgttttaatgcaagtatatcggtaactggtcgtatattcgaactcaatattttactcgttggaatcataactgtcatattactgattgacattcttatgacataatactgttgtttttcctctaagaattctttttcttctatggcttcaattatacctgctccgtgcattggataaacaatgttatcgccaatttgaaacatatcatccacctccatatatggtatccttcttaagattaccatatatggaggtgtaatatcaaaattttaataataacatgatcgaatttttgatgtcaataacttttttgaaaaaacagatcaagcaaaaacaatagggaacgtgtcggatttccaatcaggaaaaggtcaattgatccgtgtgagcagtttttcattggctcaatgacatcacagaaatgatttgagtagaaataagaaggaacgatatttgtgaaatgtcagctaaaaatattaaaagtacatgattaagttctaatttctttaccgatttgatatggataacggcccacttacttaatgatgcattttcacttatcttgcgaacagaaaaaggtttgtggatattgaacattttgccaccgagattggcattattatcatggaaattgacaaccttcaaatgggtattgaggtgaaaagaaaaataaagaaaggagagattataaatgaagaccagaacataaagaagtgaaggggaaagaacaaggttaattgaaaagcaaactatataaaatagtttgcttttctttttgttatgaattcacttctttttctttctctttaatgactaataaaacaccgctcagaattaaaaacgaacctatccaaaatgtcccgcctatttgttctccaagcagaatccatccgagtaaggttccaaccagaggctgaaaaaagaaaaagaggcctccacttgaggcatttaataattgtaagcctcggttccacaataaaaaagcacaagcggttgaaacaattcccaaatacaaaagaccacctagaattttagggtcaagcagttgtgatgtaaaaatggtgctaggttttacaaaaggagttagcgccacaatggcaacaaaagttgaatatgttgtaacaagtattggtgaataactgcttggaacgcgtttgatcagcactgacataagtgcccatgtaagggctgcaacaagcagagaaataccgccaagctgatgagatgtatcaatatgtccgtttcccacaataaagaatacacctatggtcgctaaaataattgaggttccttttttgatagtcaatggttctttaagtaatagacgagcaaaaataaccatgaacgctggtgtggaggacgtaataattgctcccatttgtgctgaagacaacatcgttccatattcttgtgtaacaattgaaatggtgttgccaacaattccaatggccacaattaataaaagatcgcgcttatgaattttccaagattgtttccttattaaaccaacaataagaagcgcaaggatggcgatgacatacctggtccaaaccaattcaaaaggcggaatcactgcgacaacaaccttaaccacaacatacatgccaccccagatactagcggctaaagctaaatatatagaacctaacagggtatttttcatttttttgttccctccgtatttaaaattaggtcaataaatgccctaacggagagaagtagtcactttactccattaagggcggagaagtgctactggaacatcattttcaaatagtggagctaaaaacatgttatgatcacctcgatttttaagaatgactatcattatacaatgttggttataaagccgtaaacaccttaaggggactccatttattaatagaataaactttatgaattcatttttttgtatgataatggcgtcatattcatcgcttgttgaaatttacttatgaaataactggtactgttaaatccaacttgataagacacttctgtcacattggattcagggtgttgcagtaataataagcttttttgaattctataatccattacataacgtaatggcgtcttattcagcattcgtttaaaataacggcagcactcagaacggctcagttggccagcttttgcaatgtcctctaatgtgattttttcagcataatggagatggatccagtttaacatttgtttcattcgatgactttttatcatttcagattgatcgtactctaattgaaaaccattaacgaccatgtttttccacattaacgttaattgcatcgtaatgtcaatctcatagagcgatgtcttttgttgaatcaattgatttatttttttaacagcatctagaatattttttgcccactgttgatttccatccaaaaataaatagggcaaattggttgaaaacatatagggctgaacatagcttgaatacagttcctgagataaaacgaaatggggtgacacatttaaacaaatatacgtacaatccgagccttccttttcttctgccatgtgcaggcagccgctattgataaataatccatccccttcgtgaacctctattttttcttcatttatttgaaagagagctattccttttagtatcaaaacaaattggatttcatcatgccaatgaagcggaatatagccatttatattttgattgatccttgtcttgtaacaggcaactggtaattctaccgttcggtgctctgttaattcttttaaattttgatcgatcacaaaattcttcattctgacttctcacctcaatatatttatattttttcattcgatttgagtattttttatcctattttgcatttattataacactattattatatttattagtgaggagtcatgtatgaatacttccaatagaagaatgggattgttctatgttataacaggggcgacatgttggggaattggaggcacagtagccaaaaaactttttcaagaatatcaaatcgatgtcaattggcttgtaacgacacgcttgcttacggctggaatgttacttttaatgctgcaactgttcagaaaggaccggtctcaggttattgaggtttggaaaaacaaagcgtcggctggccagcttctaatttttggcctattgggaatgcttgctgtgcagtacacatatatggcatccattcaacatgggaatgctgccgttgctacattattgcaatatttatccccagtaatcgtcattatctacacgcttttgcgaaaacaaacggttcttaccaaacaagatatcattactgttgtacttgctttagtgggttgcttttttttgttaacaaatggttcaatatctcaactttcagtgccggcagctgcagtagtatggggagttttatcaggattcgcggcagctttttatactttatatgccgttggtttattaaataaatttgattctcttgtcgttgtaggttgggctatgattattggcggttttgcattgggttttatccatccgccatggcaactggattttcaacgattaactgctgaggcgtatgcatatattttatttgtgatattatttggaacaatgattgcgttctggttcttcataaaaagcttggaaagcctttctcccaaagaaacaagcctattaggcagtttagaacctctatcagctgttgtaacaactgtcgtttggttaaaagcgccatttggttcttttcaatggattggtgctatttgtattatagggataactttaatattggctttacataaagagccttctatggagagtgaaaaatcgatattaaagattaggaatcatgcaaatcgggatatataggggctttttttgcttacatgaccggtccgacaatgaaaaacactggtggagtttgagccctctcggcaatatcaaaaagaccaagggttttgacgcccttggtattttttcttcaagaaccttcaatttttcttttttgtaattggtatccaaatttcacttttaaaagatggtgatgttacatccttatgctcgttccacaatatttctggaccttctatttgttcgtaatttgacgatggaaaccattcggaataaatacgtccccatacttcttgcagtgtatccggaaatggcccgattgattcgaatacagcccacgttgaggcaggaacttcaagccgtgagaaattatctggacactgtttcgttgtggctgcgccaatatagtgatcaagctctcctttttcctctgcccgaccttcagaaaaattggtggatgcactaatgagtcctgatggtgctacattagaaagctcttttagtttatttattgctttttcatctaaactttcccacatagatgcaatttccggattaattcctttgaaaataatatgaactctttttttaatgccaacgatgcgaaatgcctctttttcttcaatacggtagttcatttcatttcctcctttaattgttagctggaaggtcattcgtggataagctttaagggaatggccattaagtctggcttttgatgggtttatgccatgtaaattttggaatgcccgtgcaaaagaatcaggtgagttataaccgtactttattgcaatatcaatcacttttacattgctgtctttcagttcaaaagctgcaagagtaagacgtctgcgacgaatatattccgataatgaaatacctgcaaggaaggaaaacatccttttaaaatgatattcagagcagaaagcaagctttgctgcctcttgaaaatcaatatcattagtgaggttttcttcaatatactttaacgccctattcatacttttaagcaaatccatttatttggcctcctttaaccaaagaataacaggagtgaaatgtatatatccgacattctgtgcacagttttgcaggatgacttagatgaaataaagtaagtgattcacttgtatttgtacaggttttattgaagcatgctgttcataaaaaggcatcaataaaagaaagttataattgtcttataaacggcacattcatataattgagtgaaaaaggatgcgtatcatgcctatcaattcttttgaaaactatccgatgagctggaagccatcgattgataaagctgaaaagcctatttataaagcacttgcagggcaattggaacaggatattttaaacggagttttattacctggaacaaaacttcctccgcagcgagaattggctgattatttagatttaaatgtgagtacgatttccaaagcatttaaagtgtgtgagttaaaggggctgctgagtgcgactgtagggagcggcacatttgtatcgtatgatgcgttgtcgaatgcgtatttacttgaggatacaaagccgacacatttaattgaaatgggagcaatacttccagatcacgcttcatatgagcccttgttacaccaactgaaaaacatgattcaggaggaggattatgaaaaatggtttagctacggccgggcaggcgaaagcctttggcaaaaagatgcagctgtaaagctcatccaaagaggcggatttgaaacatccgttgatcacattttatttgcaaatggagggcaaaatgcgattgctgcgacattggcgagtctttgtaagcctggagaccgcatcggtgttgaccatcatacgtaccctggattaaaaactgttgcatcattgcttagtgtgcaaatcgtaccgataaaatcagaaaacgatgaaatgagtccggagtcacttgaatatgcgtgtaaaaacgaaaatattaaaggtttgtatttaatcccggattatcataatccgacgacttcctttatgtctgttgagaatcgaagaatggttgcagacattgcaaagaaatataatctatttgttattgaggatgcatcgtaccatcttctcaacaaaaatccgcttccggcactcgcctcattcgcaccgcaacaggttattcatattgcaagtttatcaaaatcgttagcgccaggcctgcgtttggcttatgtagcagtgccgagacaatataaggagccaatatcaaaggcgctttataatttaaatataaccgtttccccgctattagctgaacttactgctcgcacgattgtatcaaatcaatttgaagtcttaattgagagtcatcgtgaacaaaccattcgcagaaatcaactcgtaaaccgatatgttgcgggatatacatgtttaggtgttgaaacaggcatttttcgttggttgttgttaccgggtaaaatgtctggtgccgaatttgaagaattggctgctcgacatggcgtgcaagtgtatgcggctgaacgctttgtagtgggaaatagttgtcctgaaagggctgtaagggtttctgtctgtgcaccaaaaacacttgaagagcttgaacaaggattaatgatcctgagacgtttgctagacgatcttacctaatattgtttgccatacaattatgacattgtatggcttttttgtgcgtgttatgatgatccacatctagagggaggtttatacaaaattggcttttagaaaggaaggtcagatgatgttagacaaggacagcgtaaaagcaatagatgttcaaactgcttcattacaaagctacatcagttcaccagaaaaacaaaaatcgttatacaagcgtacactattcgttgtgagtatctcacaaatttttggcggtgcggggctggcggcaggagtgactgtcggtgcgcttattgcacagcaaatgcttggcactgatgcgtttgctggtctgccttctgcgttatttactttagggtcagcaggatctgcattaattgttggaagactttctcaacgttatggccgtcgaacaggtctttcggctggctttatgattggcggacttggagcaataggcgttattatggcagcaatcataaatagtattttcttgttatttatttcgttgcttatttacggtgcaggtacagccactaatttacaggcccgttatgctggtacagacttagcaaatcataagcagcgagcgactgctgttagtattacgatggtttttactacatttggcgcagtggcaggtccaagcttagtgaatgtgatgggggatttcgctctttctattggtgttccatcacttgctggccctttcattttagccgcagcagcatatattttagcaggtgtggtccttttcattatgcttcgtccagatccattagttatagcaagaacaatagaagcggcaaatgaagagcctggtgataaaggacatttggcggcaactgagcatacagaaaacaaaaaagggataatcgttggggcaacagttatggttcttacccaaatagtaatggtagctattatgacaatgacaccggttcatatgagacatcatgggcatgacttgggggcagtagggcttgttattggttttcatataggtgctatgtatctcccttcactggttacaggtgttcttgtagataggttgggacgtaccgcaatggctatttcctctggaacaacgttgcttttggcaggtgtaatagcagcatttgctccgggagattctatggttcttctcgtcattgctctttctttactcggattagggtggaattttggtttgataagcgggactgcccttattgtagattcaactgatagtgccacacgagctaaaacgcaggggacagtggatgttctgattgcgttgtcaggagctgctggcggagcattatctggaatgattgtggcagggtcaagttacctggcattatcatttactggagggatgttgtccttattactcattccagtggtggtatggtttaggggacgataaaggataggattgtttaatttacattaatttgttatattgttagataaagtctattgcgtcgtctaataatctaactaactatagttgctccattaaatctaaatcagcaattttggtataaagatttgtgaccaggattccttatagctgtgtcactcactgcatattctttaattgaatcacataaaatggttatcggatttgaaaaaggcaggattactcgctttaggtaaaggagtcatcacgttgttaaaaaggttttctcttgtttttgttacactaatgatgtctatcgttgttgttttagcggccgctaaagagtcgcctggagattatgtcatctcatttgatgaacctattatcttgatgatctcaattggaatcgttgtatttttatttatccctccattagtcatgtccttttttggcaatttggttgtaagaataatatctggtgtataccaatgttttatcgttttcacttttctggggctcattccaattggatttcttattcccaatggctttttgacaattctagtttctattgcaggaactttagtcagtatagctagtgttgccgtaaccttatgcattggcaagaataaaaaagatatataataattgaattgttattttttcagattgtcagtgaaatagtaaaacaagatgagaaggctttgtgggccttcttttttttgttgttgcatcatccccactttaagcttaatctattgaataataagagaaggaacctatagaagaataaaataaataacgagatgtcaaaaataaaactggacttcattattatcaattcacgtaaatgtaaaaagcttggaaagaggggaattctttcatgacaaatagcagaacgaatccgaaggttgatgaatttttaagtaaagcgaaaaagtggaaggaagaatttgagaagttgagaaccatcattcttgactgtgagctgactgaagattttaagtggatgcatccttgttacacatacaataataaaaatgtcgttttaatacatgggtttaaagaatattgtgcgcttctgtttcacaaaggcgccttattacaggataccgatggaattctcattcaacaaacggagaatgtacaggcggcgcgccagattcggtttacaaatgttcaggaaataaatgagctagaaaacattttgaaagcctatattcacgaagccattgaagttgaaaaagccggtttgaaagtggaagttaacaaaaatattgaattgaacattcctgaagaacttcaaaataaattcgatgaaatccctgcattgaaaattgcttttgaagctttgaccccgggacggcaaagagcgtacactctttatttttctcaagccaaacaatccaaaacccgagaatcgagagtcgaaaaatatgtgcaaaaaattctcgatggaaagggattaaaggattaggcacgccaaggttcaggctaaaggaatatcatcatagcgtaataagatcctttctatagaagaaaaacaagcatagtaagatgcttgtttttttcttaggacaacattcacttactgctgaaatgcttctaacattgtatgccactagacagcgttataaaatattaatgcaacacctagaaatagctcaatggtacggctcatcacatttagaatgcctaggagaactaatagaaccggaagatttttagcaagttactacactccaaactttgtttttgtattaatataccttattaaccattgtttttagtcaggtgcagacaaacgaatactgattaatgaatcatcatgatatcaatgagccgtttgattttttcatcgtcgcctgtatcaacgtacactgtttttctgttttttatgatactctcagtcacttccctcatgacgcctttttctatatcatcagcggaatcccagcgtaaaggcacattatatacatgaattgtgccatccccattgccatgataagtgactgatccatccactaaacgagaacctgccaactgggtcacattttctggatagctggcacttgtatcatcattaggattaattggctcgccagccgaaatatgtcgaacattcaattcatctatctcttgattaggtccaagttgaagccaaactctggcatattcaattttttccgaagagtatgctgccaatacattgtcttctttgcttttctcctctgctgaagaggtatcatttgcagcttttgttgcggattcttctgattctgttattggctccgcttcatccttgcgtattttggtgctgtcttcagtctcagtgtgtttttcgtcagtttgtacagcagaagcttgatttgaaggttgttgtgcttcttcatccttactgcccgtacatccagcaagcaaaatcatgagcagcagggcagtattgcaatagcatatcattctgcatttcttcattttttcattcctctccattaactcaggtcagcttcatatataagtttatgtatctaaatattaccatggaatagataggatgatgttgaaaactgtttaagaagaggaaacgatcttgaatagcatcgcgaaaacttaagaattcttaagaagttttgcccctttttcttcaggttttgaatgtaaagtgggatataaatgcaaaacaaatggagagattagatatgaaacgtctgttattcttatttcagtatatagtgaatccgagaactgttggtgcgatccttcctagttcaaggtatcttggagataaaatggtggatggaattgatttcaagaaggctgcatacattgtcgaatacggtccgggtacgggtgtattcacaaaaaaactgcttgaaaaaagaagacctgaaacgactattttattagtggagcaaaatgaagaattttatttactattgaaagagacatttaaagacgaaaagaatgtatttattgtaaatggatctgctgaaaatagcagccagtatgcaaagaattatggtatgccttatatagactatgtgatttctggccttccctttgcaagcttgccaaaaactgtttcagccaacattttattagataccgcaaagattttaaaaagagatggtgaattcattacttttcaatacactatgttgaaaaaaccgttttttgaacagttttttaccaaaatagatgtaaaaagagagcttagaaatgtaccgccggcttatgtctttagctgctcgatgccgcaaaatgatttggaggaattatatggagtcgaacgttcttattgttgatgatgacaaagacattagaaatctcatctctgtttatttagaaaatgaaggcctgtacactcaaaaggctaaagacgcaatcgaagctttaaacctgctggaacaaaaagaatttgacctgatgattttggatattatgatgcccaacatggatggtattgaagcatgtatgaagattaggcaagaacgaaatctgcctattatcatgctttctgcaaaatctgaggatatggataaaattcagggacttgccgctggtgccgatgattatttatcaaaaccgtttaacccattagaattaatcgctagggttaaatctcagttaagaagatataaaaaatacaatactgatacaagcagcacgaagaacatcattgaaattggtgacttgaccgtaaatacagatacacggcaagtatgggtgcggggccgggaagtcaggctgaccccaaaagaatttgatatactcgaacttctttgcatgaacaaaggaatggttctgagtgtggagaagatatatgaagcagtatggaaggaagacttttttaagtcggacaacactgtcatggtccacattacaaaaatcagagataaaatagaagaggattccaaacatcctatttacatcaaaactgtttggggaacgggatataaaatatgagaaagtttggaaataagctggttgcaaagcttcttggcgcgattgcaattagttttcttgtttcattgggtatgatggcactcattatattatcgaacgtctatctacaaaagatgaattatctcaaagagtttagcatccggagcagctattttatgatactgcttcagttttcggcagctattcttacttttattgcagttttttttatcatggcacggaaaaaaatattatatttgaagcttattactgagagtgttcatcatattgctaatgggaaattaggcttgaccattaggattgaaagtagggatgaattgacccagcttgcccaaaacattaatgatatgtccaaagagttagaaaaaaagtttgaacacgaaagacaattagaaaggtcgaaaagtgaactgatttcaaatgtatcccatgatttaagaacaccattaacatcaattatcggatatttggatttattaaaaaaagggcaatacgacagtaaagcgcaatttcaggaatatcttcaaacgattgattcgaaatcgcaaagactgaaatacctgattgatgagctgtttgagtatacgcatttatcgagcccggacgttaagttaacctgtaaaaaagctgatttgtcaggtttattggaacaaataataggagaatacattcctatttttgaaaaggaacgactaagtgttcaaaaatcaattgcagaagacaatgtacctgttgtaatggatatagaaaagatggttcgcgtttatgataatctctttatgaatgcgataaaatacagcaggaaaccatctgaattattcataagccttgagatcattggtgacaaagcacttttgaaaatttctaatcaagttgagggttttccggctgacaatatagacaaattgtttgaacggtttttcaggggtgataaggcaagaacagatcaacaaggaagcggccttgggctagccatttcaaaaagaattgttgagcttcataatggtaatatccatgcggattatagagagggctggatgagctttattgtcgaacacccattgtgtatataaaagcttatggaggaaagtttccataagcttttttctttagaataaaacttaagaaaccttaagaattttacggagagtttcttcattcttattgcttatcatgtaggtatggaaagtgaggagagtgtagaaattgaaaagtaaatttcttattatagctttgtggtttttagccatttatatagcaaaggaatatcatttactgtcactcgatatggatgatttacaggaatttatatcgttgaacacaaaatacgcaatgctgctgtttattgcgctctggatcattagacttctcttttttattccaggtgtgactctcatgtttttgggggagtatgctttgatccggttgtgagctttatattgtcgatggctggcatttttttgagcgaaaccttggtttacgttttttcaagaatgttttcaagcgggaacatgatgaaggatttagaacgtaaatatccagagttgaaaaaattattggagacttacaattataagtttttggcgctggggatgatttgtccaatagctccaacagatgtcgtttgttttttatcggcagctgtaggaatcaagtataccacttacattttaacggttatcgttacgaatatccctttattgatattttcgagtttcattgtgatcaattttagtgagtcattaatgggaactgtattggttgtcgcatcatttgttttggtttctattgtatccattaaaatgtggaacacccttaagcataaacggagcacatagaaatgccacgagactaaccatttatagcttataagcacctgtagagatttaagttctttcggtatccaatagtaccaagggttaacagcccttggtattattttctgctgcacatatataaaccctccattttcgcttgtagatccttttttatttttgtattttaggttgaatgatcaccagaagaaaaatgaacgcatgatctgaaaagctgttttgccgcaaaataaataacaccccgatgatcaacgataacaatcccgctactacgatatattgtgtgtctgattttgattactgtatataatcgttttttagtaaatgctctttcattttttgtatagccttcgcttcgtcagatccatttgcgtgtatatatattttggttccgggtttaattcctaaagccataatgtccatgatggcttttggcgcttgtttgaggttaacagttttcccttggtattcaagaaaaatatctgatgtaaaccgatgagctagtctgactaacagggtagccggtctcgcaaaccctgtttccttaatgatcgtaaattgtcttttaatcattcttcacctcattacattctgcctcttgacggatttatagttgggttgcagatcaaatttgaatttagagtacctttaggataagtgatctaatttcatcgaaataacactctttctttgtgtttacaaaataattctcaactaactaaaatggacaatgacttcattcgagaaaaaagcatgattcactatcagcttttgtttattattgtaaataaaaacatggtgtgtacaatggttacattcaggcgatttgttgattattcaacattccactctaaattgttgattatcttaagaaagtttggtgaaaagctatgtccaaagtggatagaagaataaccaaaagccaagaggctattaaaatagctctgattgagctgatgactgaaaaaagttttgatcatattacgattaaggaaatttctgaaagggcaaatgtaaaccggggaacaatctatcttcattacttagataaatttgatctattagaaaaaattatggaagagcatataaacaatatgggggatttttgtgagtcggcagctgaaatggactggattgaatcgactgtacactgcatggaataccttgagagtaattatttattcttttcgacgatgttagccagtgaaggcgctcgatattttcgcagtcagttccttaagtttaatatcgaagagttcaggaaagatgtagatgtaacgaaaggcaagaattacggccaaagtgaagatgtcattgttgaatttatagcaaatgcttacgtaggggtagtggaatggtggttaaaaaacgaaatgccttatccgcctcgtgtcatggcagaaaaagtgggggagttattagagcggattttataatggaggcaggaaatgggtgttgacttatttgtctaggcgggagattcaagtctcctcgatcgcatacaaaataccaagggccagcaacccttggtatttttataccttcatgcatttttgaagtttatgcttaaaggtctgccttactttgcaaatcgccgagctgctgcaacgcacatgataacggcgatattcactgctacgagtgcccagcccactttctcgtgcagaatcactgaggcaagcagcagcccaaaaaaaggctggagaagctggagctgcccaaccgccgcaattcctccttgggcaagacctcgataccagaacacaaagccgatcagcatgctgaataaggatacatatgcaagactgagcagtgcgggaacgccgatgtccgaccatgagtccggcgtaaaaaagaacgacaagggcagcataagaggaagcgacagaacgagtgcccatgagatcacctgccaattccccagacgccgtgaaagccttgccccttctgcataaccgagaccgcatacgacaatagaagccagcatgtacgcgtcgccaagcggggatgaacctcccccctgaatgagggcgaaacctgctactaacaagctgccaacggttgagaaaatccagaagacggggcgagggcgttcacccccgcgcagtacgccgaagaccgccgttgcaagcggaagaagtccaatgaagacaatggcgtgtgcggaagtgacatgctgaagcgctaaagctgtcagcaacgggaaaccaatcactacgccaaacgctaccactaataatgaaatgaggtctcttttggcaggatgctgctgccggaagatgagaaggagacctcccgccagtacaccagctatcgcagcgcggcaaacggtgagaaaaaacgggtcgaagtctgacacagccaaacgggtcgcaggcagcgagccgctgaaaatgagtacgcctataaaaccatttatccagccatttgttgttttgttcattataatcactccacatatctttcttgttcattgtctgtattttcttaacaaaaccagcagctaaggattacaatgactataaactggaattggccttttttaaacggccagttttcataaaaaaatgcataccagttaggagaacaacgtgcaaatggatatcacgccttttttgaatagaactctggatattccgctttatcagcagctttatcggtattttaaagaaaatatgcatcggggccgtattcaaaaaggaatgaagcttccttcaaaaagactcctggcgaatcagctttccatcagccaaacgactgtagaacgtgcctatgaacagctcgctgctgaaggttatattgtgagcaagccaagaagcgggtggtttgctgattatcatgattctgattttgcttatgatagaatgccaagcacaacacccattcaacaagaagcagaagaaaataaacaatggattgattttcattatggaaatgtagattcttcttacttccctttttccgcatggcgaaaaagcatggtcaatagcttagaccaatatggacacgagctttatcggccgggacatgttttaggagagtttgagctgagaacactcattgcagagtacctgtatcaatctcggggtgttcattgcggccctgaacaagtgattataggtgccgggaaccctattctgctgcaaatcttgtgccaagtttttgagccgaatatttctatagggtatgaggatcctggttatccaagagcacgcaagatttttgaagccaaccgcatgaatattgttcctataccagtcgatgctgaaggaatctgtatacagaagatcaaagaacagcagccaaaccttgtatatgtcacaccttcccatcaatttacgctgggaacaatcatgacgatcaacagaagaattcagctgctcaaatgggcggccgaacatcaatcctttatcatagaggatgattatgacggggaatttaggtacacaggacagccggttccttctcttcaagggcttgatcagcataaccgtgtcatttatatgggcactttttctaagtctcttttgccctcgctgcgtatcagctatatgattcttccttcacctcttttaaaaaaggggcatgaaatcacatccttatataagcaaacagtgtcctgccacagtcagctaaccctagctgaatttataaaaaatggagagtggcaaaaacacatcaacagaatgagaaaactttaccgcaaaaaaagagccattgtattagaggcagtgcaaagggaattaggagagcatgtcagaattcgcggagaaaactctgggcttcgtatcttacttgacgtttatttgccatttggcgaaaaagagttaattgagaaggcgaaaaaacatggagtaaaaatttatcctgtttctctttcttatcaacatcatcctcctgcaaaaacggtctcgctcgggtttgcaggggtttctgaatccgacataagagaaggcataaaaaaactgaaggctgcctggaagatatgagggagctttcagtttagcaaaaaggccaagtgacgactaagtgttgagagctgttcaatattatttaagtatatgatgagtgcctgcagtccaggccacgatacgtctgtttagcgaaaaacagaattttttatttgctcctcacagtgctaaaataaacaaaatagacaattgaaaaaatagaggtgtaagaatgaagttagatgagtttacaattggccaggtcttcaaaacgaaatcattaaaagtatcaaaagatgatattatgcggtttgcgggtgaatttgaccctcagtatatgcatgtagatgaagaaaaagcgaataaaggcagatttaatggaattatcgcttccggcatacaaacactggccatatcttttaaactttggattgaagaaggtttctatggagacgatattatagccggaacagagatgaatcatatgacattcataaaacctgtatatccggatgatgaattgtttacaattgttgaggttcttgataagcagccaaagagaaatgaattgggaatactcacagtattgctatctacttataatcaaaaagaagtaaaagtgtttgaaggtgagttatctgtattgatcaaacgataactcagaaagcccgcttttcgcgggctcgattgaagcagatgggggaaagatgttagcgagtttcctttgaaaaataagaggttaaaacatcataaacaataggcaaagaagtaaatccctcatcttctagaaaatgacctccgtgctgaacttcatataacgcagcatcaatttgttgtgccagatccttgctgaatgaaaaaggcacaatttggtcgtccttagaagcaatgacagcacggtgcttcgcggactcaatgattgtttgatgatcaaacgatccctgtgtaaattcatctaacatctttaaagtgggcaatgatttggcaaagccggaaacaagtatgattccgccaagctgttttcgtaattgaagatgttccaaaaatctcaaaatggcggggcaacctaagctgtgcgcaaccaaatacgtattttcatgtaaagtgtgctgatataaagagagtgtatccagccaatcctcaagtcttggctggagcggattaggcatgtttaaaatgtctgcttggaccccatctgcgagcagacgttttttcagccaagggaaccaatgatttgttgaggaggctctgtagccatgaatgatatagacttgttttgtcattatttcctcctaagaaatattttcattcagtataaaattcctctcattgggaaacaagtacgcacttttttgtaagtagctttacatatgaggccctccttgtgccattccccacttacacatctcatctatgaggggatacaaagatcgccctctgtcagataacgaatactctactttcagtggggtttgagaaacctcagaccgatgaataaggccgtcagtttgcaattccttaagctgtgcgcttaacattttatgggtgatgaagggcatagcccttttcagctcgccgtatctcatcgttttttcactaccctaactcatagagaattctcattttccatttgccccctataagagataaggtgtattcaaatggggcttgtttactgcggcacaggctattcattgtaatcaaacctccttttttaagtatcatatcagaataaattaggattttcggtgttgaagtttgagggcgattcacgatctgaagtgaaaggggccgcttgctcaacaggcggcacggtacatgaatgttctaagtcaaagagggttaccttactgttagttactttatttaaaaaaacgcatgtttttagctgaaaatatctattatggtatatttaaatataaagaaatatttgagaaatgaggaatggtatgaatacacccaaaaaacataagaaatttaaagcgaaaatgattctccaaatcatcatggttatcattggaggaatcatagcggcatatggactagaaacagtgctcattccaaacagtgtatctgatggaggggtgacgggtcttagcatcgttggttcacagctattcaacttgccgctggggattttgattgcagtgatcaacattccatttgtctggttaggatataagcaaattgggaaaagctttgcattattatcaattatcggaatcgtatcgcttgccgcggggacaagctttttccaccacacacccgccatcatagaaggagataccctgttaattaccgttgtcggcgggattatccttggattcggaatggggctggcgctgcgtaatggcggcgcattagatggaattgacatgcttgctgtgctgctatcccgaaaactgccattcggaacgagcgatctcattctattcttaaacctatttgtgtttatctttgtttccacagtatttggcttacaaggggcattgctttcagtcattgcttactacattgcatccaaagtgattcatgttgtggaggaaggcttaagcggctctaaaacctttcaaattattacaacccaacctgaattaatggtagagacaatacgtgatcaattaggccgaagcgccacatataaagaagcttacgggggtttttcccacgagaaatttaaagaaatcacatgtgtcatcaaccgtttagaagaaaccaaactaaaggaaattattaatgatattgataaatccgcctttgtcaccgtatatgacgtagctgaagtgaagggcagcaattttagaaatcttaatcatcactaaaaaatagaatgacctttttaaccgtaactgacatgccgcgggtaatttaatcaaaaacacttttttgagggcttgtgggtgtcaccagtgaaggtctgaatcataaaaataccaagggaatcaaaacccttggtattttttctggttattagattttatcttcagctttacgtgctgcttcgagcttatcaatcctgtctttatatttttctccccagtccttcatgtgcaggataacaggttctaatgttcttccaaactcagttaaagagtattcgacttttggagggacctgtttataaacctcgcggtgaatcacgccatcccgttccaattctcttaattgcagcgtgagcatacgctgggtaattttggggtatagttttcgaaactcattaaacctttttttaccgtcaatgagatgataaagaagaatgcctttccacttacctccgatgatatctaatgttgtctccaccggacatccttcaaagtcatcagaagaataatcaatgccgagtttacgatttctcaagctgttcactcctaatagtatactttttgatactatatacattcaatgtgcgtactttttatatattaatatacatcatataatgatgtcacatctaaggaatgaaaggaatggatcatatgaaaacactcgtactcgttgtacatccgaatatagaatcctctcgtatcaataaaaagtggaaagaagccgttttaagtgaaccagatgtaactgtccatgatctttatgaaaaatatcgcgatcaaccaattgatgtggaatttgaacaacagcagctcctggcccatgaccgtatcgtttttcagtttccattatactggtacagcagcccaccgcttttaaaacagtggtttgatgaagtgtttacgtttggctgggctcatggtcccggcggaaataaattgaaggggaaagagtgggtaactgccatgtccatcggttcacctgaacactcttatcaagccggcggatataacttgttttcgataagcgagctgacaaaaccgttccaagcatctgcccatttagtaggcatgacctatctgccttcctttgccgaatatcgcgccaatacaatcagtgaccaagaaattgccgaaagtgcgaatcggtatgtaaagcatattacaaatatagaattaaacccgaaggttcgcctgcaaagatatttgaaacagctggagggtgtcgatttaacataaagattgattttggaaaatcctgtactcaccaagcaggattttttcttgttcagcagagggattttaacatatagcgaaaaaagaagaagccaccaaaaataagctatttgcttggtcctgactgcttatttttggtgatatacttatttctctgtgatgaaataaagcaaagcgatgaccggaaaagcgattccaatccataatgctgtactccatccccctgaggcatatgcccatcctccaattgatgaccctatcgcaccgcctagaaagaagatcgccatgaataatccgtttaatcgactgcgaatttcaggcgccaacgaaaaaatagcacgttgactgagcacaaggtttgcagatacacccatatctaacagaatagctgcggccactagaactgttataccgacgggggagctgctctgaatcatgaggggtaataataaagagacaacgacaacaacgagagcgattccagtggcaagcctggttaagcctcgatcagccaggcggccgcctattggtgcagcgactgcacccgcaatgcccaccaatgcgtagagtgctattgccttctgagaaaaatgaaaatcaggaccggccaataataaaggaacggtagtccagaacaagctgaaagctccaaatacaaacgcatgatagatggcacggcggcgtaagattggagtcgtgcgcagcagcttccacattgaaccgagtaaggcagtatagtttgtatttgctgttggttttctggcaggaagcacttttgataatacgatggccaggataacacttaccacggcggacaaagcgaatattgcattccacccccagatatcagcgactagactagatatcggacgggaaagcataatccgagtaataagccgctcatgacattgccaacaacccggccgcgtgcagcgtctgatgcaaggtatgatgcaaatggaacaagcacttgggctgcgattgatcccaatccgacgaaaaacgcagctgctaaaaacagtgttccatgcttcacaaatgctgttagtgtcaaagccgctgcgcttagaaggagcgatacaacaataagttttttgttttcgataatatctcctaaagggacaaggaatagtaagccggcaacgtatccgatttgggtgagtgtgacaatcaatccagcaccgcttggagaaagtccaattgccttactaattaatccgaccaagggttgtgcatagtaaagattagcaacaatgataccgcatgcagttgcgagaagaagggttaaactgggtgaaatcctctgacctgcttgtttgtttccattagccatatgaatgaactcctttttaagtggttttttgagtgtaatcatgacttctcacaagtgattttataaactgaacgttcagtttcgtcgattaataaaaataatatactaaacgttcagttttgtaaatggatttctgttttctttttttattcaatttaagtatactgaacgtatagtttatattgcgggaaggaatgatttatgtgcagagtaaacgagggcggccgcgtgatgaaggaacgcataaggcgattctctctgcagcctatgacctattgctggaaaaaggcttcgatgcggtgacagtcgataaaattgccgagcgtgcgaaagtgagtaaagcaacgatttataaatggtggtctaacaaggctgccgttatcatggacagctttctttcgaccgcgacggacaggctgcctgtgcctgatacagggtcgtcagtacaagatatagtaacccacgccacgaatttagctaggtttttgacaagccgggaaggaaccgttattaaggaattaataggtgcagggcagttggatgaaaaattggcagaagaatatcgcacgcgatttttccagcctcgccgcctccaagcgaaaggccttctagaaaagggaattcagaaaggtgaattgagagagaatcttgatattgaagtaagcatagatctcatttacggaccaattttctatcgtctgcttataacaggggatgaggtgaatgattcctatgtgcatgatttggtgatgaacgcgtttaagggagttcaagctacctctgctacagagagtatgtagctgataagaactgcaaaagctgcggattatatgacaaattggttccatcgtacgtgaaatataagatttttgttgctgagcggaatcgagggaaaagttctcttatcggatgtcgaaaaagaagtcattcaatcgtgaatacataacatcatattattacattccttttcatcgattggaacaagggttctatacttcaatggaatatcgcaaagttggagtatttaaacaacaggggaaaatcgatggccattatgtaggtgtcatggcaatcgaaaaaatacttgcaatgtaaacaggcctctaaagagacctgttttttaatatccagatgattgtctagtttcagcttgggctctatgactactcccataactgaaatagtctaatatttataccggaatatttgatgttccaaatataagggattgtttatataaataaaagtttatataatgacgggggcgctaaggaaacgcggggagcgactcaggttttgttcgaagttttgatccttaagatatacggagcgctacatatggaaacgtaaaggggaatgtagaatcatttggcgtgtatataatgatttgcttatatattgatttgggaaggaggagctcatatgacgattgatgttgcggcgatgactcgttgtttgaaaacgcttagtgatcaaactaggcttataatgatgagattatttcttgaaaaagaatattgtgtctgtcaattggttgatatgttcgaaatgagccagcccgccataagccagcatttgcggaaattaaaaaacgcaggttttgtgaatgaggacagaagaggccaatggcgttattattcaataaatggttcctgtcctgagtttgatacattgcaattgatcttacatcaaattgatcaggaggatgaattgttaaaccatatcaaacaaaagaaaactcaagcgtgttgccagtaaggaggcattagattgacatcaatgattttggcagtattcatctttttattaactctagtattggtcatatggcagccgaaaaatttatctatagggtggtcagcctgtggaggcgcagttttagctctaatagcaggtgttgtcaattttcatgatgtgttaactgtgacagggattgtttggaatgcgaccttggcttttgtggccatcatactgatatcgttaattcttgataatatcggtttctttgaatgggcagcgcttcatatggctaaggctgcaaaaggaaacggtgtgcggatgttcgtttatgtatctctattaggagctatcgtcgccgcgttatttgcaaatgacggtgcagctcttatattgacaccaatcgtattagcgatggtcagagcattacattttaatgaaaaattagtttttccttttatcattgccagcggatttattgcggataccacttcgcttcctttagtagtgagcaatttggtcaacattgtttcagcggactattttcatattacgtttattgattatgcatccagaatggttgtgccgtacttgttttcgctgctggcgagcatcattgtactttaccttttctttagaaaaagcataccaagacgctatgatctgactgaggttaaaaaacctgttgaagcaattaaagatcaaaacatgttcagactgtcatggtatatcttagggctgctgttaattggatattttgcaagtgaatttttttctatccctgtatcagtggtagcgggcagcattgcgatcattttcttaatcgctgcgcaaaagagtccggccgtccatacaaagaaagtggtgaaagaggcaccgtgggctatcgtattcttttcaattggcatgtacgttgttgtgtatggtgtccgaaatgccggattaacggatgtcctttcagatgtgattcaagccgcagctgatcaaggattgtttgctgggacaattggaatgggctttattgcggcgattctttcttccgttatgaataacttgccgactgttatgattgacgcattggctattgccggtacagatacacatgggatgatgagagaagcgcttatttatgcaaatgtgatcggttcagatttagggcctaaaataacgccgattggttccttggcgacattattatggcttcatgttctttctcacaaaggtatgaagatttcctggggcacgtattttaaaacaggaattatcctcacgatacccactttattgatcacacttgtcggcctgtatatttggctgctgataatccattcttgtttctaaaaggacaaggtcactatatcaaggaaaacaatgcactggtaactcttgacgcagccaaatggctgaagggtgggggagaaaataccttggggctaagtggaatgtgtacagcgcaggaatcgaagctcatggatgacatcgagtgctgttaaagcaatgaaagaagcagggattgatatttcaaatcaaacatcggataaatttgatgatccggcaaaagcacacggaacagaagaagtgtttccaaagggtccgtgatgaaattggtgaccgtttaaaacagtttgctgtaactggagaataaagaatcgatatactcagcgttttcttgggttatataatgcaatgtgttgttcaacaggtgtctgcgggctgagtgcaaacacctgtttttgttttttatttgtctgagattcgtaacagggaagttatttagctggtgacagaggaaaattgattttgtgaacagaatcatgaaggagacggtgttttaaaggagttgtctgttttgcaggaattaacaaaagaaaaatacagtagcttaaaaacaatgtttgatgacaaatattgtcccacatttgtctattcaatattagaccaaaccattccgggagctgtttatgcagatgatcaaacctttcctaaatcgttttttataggaactgaatcaggcatttattttattgcgggagaccaagggaatcgggattttcatgatttcattgcaggatattatgaagaacaagtgaaatcatcaaaacgatttaccttgttttcttccagtgatacatgggatagcgtactgaaacccatactgaaagatgacttaaaccaaatgagaagagctgcattttcttatcaaccaaaatctttcaaaaagactttgcaactgccaaaggggcttgtattgaaaagaattgacgaagacatcatttcacatagcacagcgtttaacagcgcgtattatgaggagtattggaattctgtctcacagtttgcttcaaaaggttttggatttgccgtattacatggcaatcacgtagtaagtgagtgtacctctatatttttagggcataatcgagcggaaatggatatctatacacttgaagaatatagaggactggggttagcttattgcgtagcaaataggtttatagcgttttgtatggaaaatgggattgttcctagctgggattgtgatatttgcaacaattcgtccattgcattagcagctaaactagggtttaagacggtaacggaatacactatttactactctggctaaccttaatgaaagaaccttaaaaggagataccaaccgatgttggtatcttttttgttttagagtttttttacccttttagcagaaaaatgggtgatgaaaatcttattcattttatttacttttaggtaggtaaaacataccccgccaactgtaaccactccgcctagcagagagagcagtgtgggtatctcgccgatccagagccaagatatgatcaaggctaaagccggtgtaacataaagtgaaagggttgcttctgaagcaccgacgagtgaagtgacatatgctagtgcgaagtaaggaataaccgtcggcaataatcctaagtaaacgatagacaaagttgcgcttattgaagcgttcatcatctcttcgcctaagcctggcagaaacacaagcataggtattgttccgccccaaatggtgaatgtaacgaatggaataaaaccatatttttttatatagcgggcttgaaaaacgaaataaatactctccgaaaatgctgccagcaggatgaccaagataccgctcattgaatatgtaaagtctcccgccccaaatgcaatcaataatacacccaataaactgatcatagagccaagccatttcgtaaatccaaaatgctctttataaaacaggcgggatagcatggctgagaagatcggtgccgtagtaacgagtaagcttgcaactccggcactaactgttttttcaccgatgttcagcaaaatgtgatagaatgcaaatcctaaaaaccctaaaagaaaaatggcaggaatgtctttcaagtcgggtaggcgcatctgagtcaaaacagcaaaaagcaataatgccatagagccgattaacaaacgaaataaagcaaggtgttctggcgtgtacccttcaagtcctgcgcgaattcccggaaaagcagatgcccataaaccaatcatgagactatgagatatcattatttgaactgttttctttcgcattcctctcactcctctttacaaaaaccaaccagttatttaatgtgtttctatactaataaagatttgatgatatggcttcaaccagttcaatagattttgacccaaccaatttattttaaggagaccgattctatgagctttccagaagaaaaaaagatgaaaaagctccctaagtacagacaaatcgttcattttattaaagagaaaataggaaatggagagtggccgattggaagcaagattccaagccagcgcacgcttgcaaaagattttcaggtaaatcggagcacagtgattacagcgttagaggaattgatggccgatgggctaatagaaggcacaatggggaaaggcacagttgttatcaacaacacatggacactgatggctaagaattctgctcccgattgggatcaatatgtcacctctggcattcagatgccaagccgaaaaatcgttcaagagataaatcaatcagaatcaaatacagaccttatacagctcagtaaaggtgaactttcagctgagatttttcctttggctgttatgaaagagatgatggggaaggtatctcaacacatggaggcattcggatatgaagaaccaaaaggttacttacctttgagggaggcattaagcaactatttaaaaaccattggaatcaacgtctcatcttcttccattctgattgtctcaggagcgttgcaagccttgcagctgatatcaatggggctgttacaaagaggatcaaccgtttatcttgatcagccctcctacctttattcattacacgtatttcaatcagctggtatgaagctgactggacttcctatggataatgaaggacttttgcctgaaaatgttcatttaacaagaggagagcggggaagggctatcttatatacaaatccatgttttcacaatccgactggtattcttatgtctaaaaagcgacgggaagaaatcctagcagtaagtgagaatacacagcttcctattattgaagatgacatttatcgtgagttatggatcgatgaaattccgccatatcctattaaaacaattgataaaaatggacacgtactgtacataggaagtttatcgaaaacattaagcccaggtttgaggattggatggatcgtcggaccggaaccggtgattgaacgtttatctgacattaaaatgcaaacagattacggatccagttcgctatcccagagagtagcggcagagtggtttacttccggccactaccagcagcatgtagaaaaggttaggcagcaattaaaggtgagaagagaattggccttgagtgctttagaaactcatttgaaagaagtggcgacatggaatatcccaaaaggagggttttttgtctggataaaaatattgccttccatatcaatgaaattactttatactaaagccttatcaaaagggattctgatcaatctcggcagtatctatgctcaggaaaaagggaattatattcgcttatcatatgcttatgcatctcttgaagaccttcaaaaggggatttatgagttgggtttaatgattaaagaattggcaagcaggtaacttttatatccttaaatggatgtttcactaaaaaagagatcaagcctaatgatcgcttgatctgataataacaagggttactagaatagaccaaatcatggttcggtcttaaaataatcatgtctctgaacgaaaagtctttccgacttctcttcctaaaccaaagtagtgtctgaaattatagataagcgggctccatttggaagggttgatatggttttcgtccagaatgatactttcctcggcatgaaaatgtagtgcctgcgtctctacaattgcgaatgacgattcatattctggaagccgaatgtgtttcacttcggcttcgatttggatagggcattctttaattcgtgttggtgatactgtttttgattgtaaaggcgttaaccctgctgcctcgtatttttcttttttatatgtaaatccgagctgcttctttaaaggcggtatactcttttttccgctataagatgaaattctttcaacgttttcccataaatccgggccaggcaagtttatgacacactctttgtgtctttccaaattgtcgatggcttttcctcccagtcctactccaaggattatataatgtccaagagcccaagaagaagacataggactaatattagtggttccatcctcattcaatgtggttagaagaaatgtcgaggtaccataatacatgatcttgggtttgatttccttaaatcgacgagtgtcttgttttttgatgtccaacgttttttcctccttgtcacgcttacatttatattgtaaaggattaacatttcaactatcatcgaaatatgaatgtaaggaggaaaatcatgaatcctaatattgcaaaaatctcttcgttgctatcagatccctcgcgttcttccattcttctcagtctgatggatggaaggatacaccctgcgggagagcttgcatatctcgctaacattaaacctcaaactgcaagttttcacctgaataaattgcttgaagcaaagctgattagcgtagagaagcatgggagacatcggtattacagattggctgactcagatgctgcaaatgtgatcgaacaattgcttcatattgcgcctaaagcaaaagtcacatctttaaaagagtcaaaagagaaaaaggacttgcatttcgcccgtacctgttatgatcatttggcaggttatgtgggcgtgcaaatggcacattcattagttgagcaggggatgttaaaaaaagttgatttaaactttgaggtgacttcagagggtgctttattcttttcaaagttaggcatcaatgaagagcaacaacggaataagaggagagcctttgcccgctgctgtttggattggagtgaacggcagcatcatattgcaggagcattaggaaacgccctattggtgcgcatgttagaagaagagtggatcgttcgtatgcctaaaacgagagcgattaggattacacaaagcgggaaaatcgcgtttgaaaagcacctaaacgtgaagatttaggatgttgaagcgaaggcacgatatccaggaggaggagtaagatttgttctaatcttactccttcttcttattttgaagcagctcgattccccattgcaatagagatgcggttccaactgtttatttgattaatgatcagaacaaggtcaacataatgtttttcatcataatgttcccgcacccgatgatatagctcatcaggaacccttttagatggaatgagcgtgatgtgttcagatagttcgagagccgctttctcttcaggtaagtaaaaatcacattcattccaagcatgtaaacagtaaattcgctgttcagtttcccccattttgcgggcatcggacgtatgcatatctatgcagaaggcacagccgttgatttgagagactctgattttgattagttctctcgtcgttcggttaattgaggattgtttcgtgtatttctccatatccatcatgattttcataccttcaggtgcaatctcatagtaggacactctttgactcataaggcaagactcctttccattgaatacctagattgtatcccggtattgatcattttaccaatgtgcggtttgaatgacagctgtttcagcgtcttttggaaagaagtttctttgaataaaaataagggtagccagcaatgatgagtggggctgctaatgcaagcagtatccatgagcctgattggctgtctctagtgactctaatgaatatataagtaccgatcagaaaatataataaagcacctagaaaccaatacatgttcaatcctctttttccttgctttttggttgcgcatttttgtctgtcatatggcttaatcgatcagggttctgattttttaataccttttcggtccggattccttttctctttaatgataaaattgtgagatcaatcgatttcaatgatgatcattccttcaatgaatagtaagttccttatgattttaaaggtaaatttgaaaagataaaacgtacatagaggcagaacgttcatgtacgtttgggcaatgatcacttattggaaactctaatgtttccctgcacctgatattgttgtgttccttctcttcctataaaatgattggatacatgtatgtttgcacgttgaaatatgggttcgattttcatgaatctctattcggtgaaacaggtaaaggaagtggataaggtttgcttataaggaatccttttaaagataaatattactcacatgataggcgggcattaaacatgcttgcactcagagtgccgggcctggcttttattctcatgatctatatagcctctatcgtgctgcaatttgtttctgggggctggtccattttattgctttatgcgtttaccatattaatcgccatttttgctttgcttcattggcactcatatcgctgggttaagaaaagagtgattctgtatttcgcggtacaaggtttgatcacctttgcacttgctaatctcatgactggcttctttatacttgtcattatcggcctttatgcatttttaattggacaaatcataggaatggcagacagaagaaggacttttctcattctttatctattgctgctgctggtcataaattcggcgtttcaccttcataaaggtgaagttttgcattttattgttattgctgggccaatcatgattgtcatcatcacttatgctgcaacattttttgcccaagtcgatgaaaaaataaaagctcaattgactcttgaaaggctggagctggctcatcagcaggtagaacagctgacgctgcagaacgaaagacagcggatggcccgagacttacacgatacgcttgctcaaggtcttgtcagtttaaatatgcagctggatgcgattcatgttcatctcgccaaaggcaacacagagagagcgaaggaaatcatacaacaatcgatgaaaagagtgaaaagcacattagctgatgcacgttcagctattgacgatctccgcagcaaatcagaagaaatcggtgttttaaaagaaagaattacctcgctaatggatcattttatagagtcgacaggcatggcttgtttattagattacagattgcatcaggtgctggatgtgcgtacagctgaaaactgttattacatcattggagaatgcatgacgaatgcggcaaagcatgctgaggcgaaaacaatctggatatccatttgggatgatgaaaagggaaggctccatttaacagttaaggataacggcaagggatttgatgttgaaaaaggaaagaaaaagagaggacattatgggcttcttggcatacaagaacgcgtcagggcaataaatggccaattcaatatcaagagtacaaaattgaaaggaacacaaattgagatcactgtaccaattcagggagagatgcaagatgaataaggttttaatcgttgatgaccatcttgtcgtgagggaaggtctgaagcttttaattgaaacgaatgatcaatacaccattataggagaggcggaaaatggaaaagtcgcagtccgtcttgcagatgaattagaaccggatatcattctgatggatttgtatatgccggagatgagcgggttagaggccattaaacaaataaaagaaaaacacgatatccccatcattattttgactacatataatgaagatcacttaatgatcgaagggattgaattaggagcgaaaggatatctgttaaaggatacgagttcagaaaccctttttcacacaatggatgcagcgatcagaggaaatgtgctgttgcagcctgatatcctcaaacgtctgcaagaaatccaatttgagcggatgaaaaagcagcgcaatgagacgcagctgacagaaaaggaagtcattgttctaaaagcaattgctaaaggtcttaaaagcaaagcgattgcctttgatttgggcgtctctgagcgaacagtaaagtctagattaacgtccatttacaataaattaggcgcgaattcaagaactgaggcagtaacgattgccatgcaaaaaggtattctgacaatagacaactaaactgcatatttgaaagttgcccaaacgtacatgcccgaatgtacgtttttttcatttcattgtcaactacaatgagaaagaatgtgatcaagcaatgcgttgaaaggagattatcatgtcaaaaatgttatatacattaggaggatgggttgctcgcaatcgcataaaagcaatatgtgcgtggatcgttgtgttagttgctgcgataggccttgcagtgaccttgaaaccaagtttttctgaggatatgtccatacctgacacaccttcggaaaaagcgatggatgtgattcaaaaagaatttcctcatggtcctgataaagggagcatacgggttattttcggtgctggtgatggggagaaacttactgggaagccagcaaaaaaagcaatagaagatacgttcaaagaaatcagtaaagatgattctgttgactcgattgcaagtccttttgtgacagggacaatcgcgaaagatggcacagttgcctatgctgatatcaagtataaatcatcagcagatgatataaagaattactctatcaaacacttaaaagacagtttgaaactggctgatgatgaaggattgcaaactgagctaagcggagatgtaccgggagccgagatggagataggcggtgtctctgaaattgtcggcattatcttggcttttgtcgttttagcccttacattcggttctttattaatagcaggtttgccgattttaactgcactgattggtttaggtgtaagtattggactggttttgattgggacacaagtatttgatattgcttccgtcagtctttcattagccggaatgattggccttgctgttggtattgattatgctttatttatttttacgaaacaccgccagtttttaggcgaaggcatacaaaagaatgaatcaattgcgagagcagtgggaacagcgggaagcgcagtcgtttttgcgggacttactgttatcgttgcactttgcggattaactgtcgttaacattccttttatgtctgcgatggggctgacagcagggcttagtgtactgatggctgttttggcttccatcacacttgtgcctgcggtcttatcgattgcagggaagcggatgattccgaaatcaaacaagaaaatagaaaaacaaagcactgaaacaaatgtctggggacgctttgtcaccaaaaatcctatcatgctaagtgtatgcagcattctgattttgatcgtcattagtatcccatctatgcatttggaactgggcttgcctgatgctgggatgaaagctaaggataatccggatcgccgggcatatgacttgcttgccgaaggctttggagaaggatttaatggccaattaacaatcgtagcggatgccacaaatgctacagaaaataaggcggaggctttcgcagatgcagtgaaagaaataaagggtttagaccatgtagcaagtgtcacccctgtaatgcctaataaagaagggaactttgccatcattacggtcgttccggaaacaggtccaaatgatgtcacaacgaaagatttggtacacgatgtacgcagtttgtcagataaaaacggagtagatttgcttgttactggatcgactgcagtgaatattgacatttcagatcgcctgaatgatgcgataccggtgtttgctgtacttattgttggctttgcgtttgtattgctgaccatcgttttccgttcgctgcttgtgccgcttgttgctgttgcaggtttcatgttgacgatgacagccactcttggaatctgtgtatttgtcttgcaagacgggaatctcatcgactttttcaaaatacctgaaagagggccgatactcgcgttcctgccgattttatctattgggattctgttcgggttagccatggattatcaagtattccttgtcagcagaatgcgtgaagaatatgtaaaaacaaacaatccagtacaagccattcaggctggattaaaacacagtggtcctgttgttacagcagccggcttgatcatgatcttcgtttttgcaggatttatctttgcaggcgaagcttctattaaagccaacggattagctctttcctttggtgtgctctttgatgcctttattgtaagaatgacactgattccaagtgtcatgaagctgatggggaatgcagcttggtatttgccgaaatggttagacaagatgattccgaatgtggatatagaagggcatcaactgacaaaggaaatacagccggaaatagatcatgaacaaaagaaacaaatcagtgtgtaatagaaaaagcagatctttaatgatctgctttttttgcatatggtagtatttagaagatgaagtcggcagttaaaaggagacacttatggcgccatcactcattttcgatatggatggaactttgtttcatattggcagaagctgcatcatactagcaggcatcccaggagaagtgacatgattttttgactttgcattcactacttgatgccaaggatcttgagaatccttcttgaaaataaaggattttacaactgatcatataagaaacctaaagaaacaagcacacaaaaccagctgcgggttttgtccaagaaaaatagagtccatgagagagactctattttttgaaatgcccggctagaagtatattgcaggtctttatgaatgcaaaacactatcttataagcccttaccgtgaaatgcctgtttctgcattgaaaaaacgcattacacgttcatttacgtaagcgggttgttccatcgataaaacatgtccggcatttttaatgacttccgcctcaatatcaggaacgaatgaagaggctcggtgcagggctgagtggggatcatagatgacttcatgttcaccaagtaataataggataggaactcttgctgaacgtaattcctcatcggtaaaaacatacggaaatccgtctgctttaggatttggatttcttgatccatcctgccacattacccctgcctgaaactgcttcacaaaaatcgggtgcagcacattctgatcattcatcatccaatttaagaatgtttcaactccatttgacgctgtaaggccaagagcgtatttgtagaaatcgtgatgaaatggcaaaaacgtttctgccggactcagtatagctgcgctttttactctctcaggcatacgtaaaaggaaattcatcgtatggagaccgccaagcgaaagtccgatcatgtgggacttttcgatccccagattgtcaaacacatcaagaagccaattggcgtaatccgttcttgtaccgcttaaattctcaggaatactcttgtttttatcacctatgatatcaactgcataagttctgtatttgctgctccaatcggcgatgttgggataccacatcgtcgagctgaataatgctccgtggagtaatacaagcggcggggcatcctctgggccgcttgcaatcacatgtgtttgaccaaaacgagtagatatatagaatgatttgcaacggaccggccaaagactaaggctttcattataagtttgataatagcggataccgttgtcacttaattcgggaatactagatgaatggtttgacatacaaatgcccctcccaacattgtttaaatgaatgtgccgtttcgtgatggggaatctgattttgatataacagactttatttacaatataatacagttgttgttagacgtcaaatccaagatgaaaaggaaataaaacgattggaacagattattgaaaatcaatataacagaatattaacctcctttgtggagccgcttcattaaaaccgcaatccaaatgcatgaatcacaaaaatcacaacaggagggatcaagagggaaggcagcaaattcaatgttttgaacttcttgattccaagaatgcttagacctgaactgaggatgagtatgcctcccacaattgtgatttcattaataaggtctgtattgattgcgctctccattactttagcaaataaatagatggagccttgccaggcaaataatacaatggctgcagccgctattccaaaaccaaaagttgaagcgagcacaatggaggtgatcccatctaacatcccgtttgtcaggaggtatgtataatctccatgcaaagcggcttcaacagggcccaatattgacagcgaacctatacaaaataataagaccgcagtagataagccctctgctaaattacttttagaaaatttgttcaccagcttgttgaatcgtaattctaaattgatgatctggcctagcaaacctccaatggctaaactcacgatgaatagaatggggtatttactatcaggcaaatgctgtgtaatggcgttgatccccagcgcgactgcagcgaatcccattgcctgcatcaaaatatcctggtattcatctttaatgccttttttgaatatccccccgattatgcttcctgcaatgatcatcactgtgttaaaaatcgttccaaacataagctttctcctccaaaaatcattcctgcataaaaaataaaccctctagttagtagagagtcaagggagatcaaaacatattcatgagattatttgatgggcagcaggatttcagtcacgtaattatctaggttattcgtaatgccataatcaatgagtgtgatttcgattgagtcccctgctacttcataatgatgttctttcatatatgccagtaattttttgtagtatggttcggcttctggatgtgaccctttaaacctaatttgcagatattctcttgaaggaaagatgatttctgaagaagttttttcattttcatcttcaagaatcataaatatactggaatatttgtcaaactgttttgctttcacatttgctgcagaaatggataaaccgatcttgcctatgaatatatcttcgtttacattcaggtgggttctcaattcagctaacgaatgttcgatatcatggccgagaacatattcatgctgcaagtaagccacacgcattgcgggaagtttgatttttgaaatttgatgtaacggcatgttaacggcatcttctatatgtgtgatgcgtcgggagatctttcgttcgatgcgttccaattctttctttttgcgatcaatttcagcctgctggctttttagtaaatgaagaagagtgtttgtattttgagagttataaaaatcaagaagcttattgattggcaggcctagggccctcaaatacttgatggtatcaagccgctcaaactgttgggtagaataatatctatagttcgtttgctcatctttatattccggtttcaaaaggccgatttcatcataataccgaagagcagagattttcacattgaataactttgacacttctccaatcgaaaaaaattccttcattctaacaacctttctgtgcctatgattgatatacacacattatatagtacggcgagttctaaaggtaaagtttgcatcataaagaaaaagctccttctaaaaaggagcttttcactcttcgaaataaggatttacatggatgagcacttcttctacatctgaaaactgtcttttgatttcatttcgaatttcgcgggcaatatcgtgtccctgcttaattgtcaaatcatgatccaaagataaacggacatcaagcaatttatagtggccatgttctcgcgcgcggattctatcaattcgttttacttgatcacattgaaaaataacagctttatattcctctatcagctcgggatcaacactcttttccatgagcacatcaacagacggcctgattaattccattgaaatcttaaaaatgaggtaagcaacgattgcactggcaatggcatcggcgtacaacagataggaccatccgcgggtgtttccgatgatagccaacaggacgccgataaaagcggcaagagaggcaacgatatcgcctttatgatcgtacgcaatcgctataatcgctttgctgttccatttttccccttgctttatagaataacgatataagatttccttagccacgtacgaaatcagagccgcaaacaatgcgctgtattggggaacgcttggccctttaacaaaggacagaatcgcttctatgaggatataaacggatacgatcactaagataattcctacaatcgcctcactaatgacttcagcttttccgtgaccaaaaggatggtcttgatcgggcggtttattggaaattccgatcactgccaagactgcaatcgaagcaacgacatctgccgcggaatgtattccgtctgcaaacacggcttcactatcgcctaccagcccaaaaaagacctttcctgccattaagatcagattggcgatcaatgcaatcaaagcaacttttctgcttatttgttctctttcacttgccattttttcctcctataaaactgcacaaaaaaataggagtgctctatatacgctctccgtatcctttcctgtgtaatcactttgtttatcataccaattcaatttcgagtgggtctatagcaacgttgtttcctgtttactaataaataaggtgacagaaaaaaagttggagctatgctaaaaaggtcatacagcaaacaaatgagttcttatgtaacaacagtgatgattcgctattaaaatgctgccgtcagtgaaaaatttccacctaattttcaaaaacctattgacatgagaagatctgtattttactattatctcatattcaagatattttaatttgagatatttggtcggaaagatcagcgatcaagcgcatctctaagtgttcaatccgttgtcatttcttttacacaatattcaatatggattttttataataaaatatctcgaattcgagataaaagggagtgtatcgtaatggctgaatttatacagttagtcaatgaaagacgatctgcaagcaattttctttcaggtcatccaatcacaaaagaagacctcaatgagatgtttgatttggttgcattggcgccatcggcttttaatttgcagcatacaaaatatgtggcggttcttgaccaggacgtaaaggaaaagctgaagcaggccgcaaatggacaatataaagtggttagctcttctgcggttctcttggtattaggggataagcaggcatatcaacaagcggctgatatctatgaaggtttaaaggtattggggatattaaataagcaagagtatgaccacatggtgcaagacaccgtttcgttttatgaaaacaggggagaacaatttaagagagatgaggcgataaggaatgcttcactttctgcgatgatgtttatgctgagtgctaaggaaaaaggctgggatacctgcccgatgatcggctttgatgcggaagccgtaaaacggattttgaacatagacgaccaatttgaggttgtcatgatgattacgattggaaaagaaaaaacagagagcagaagaccgcgcggctaccggaagcctgtgaatgagtttgttgagtatatgtaaaaggagcggataaaaatggctaaaaaaacgatgggaattcatcatattacagcgattgtcggtcaccctcaagagaacacagatttctacgcaggagtgcttgggcttcgtttggtcaagcaaactgtcaattttgatgacccaggtacgtatcatctttattttgggaatgaaggcgggaagccgggaacaatcattaccttctttccgtgggccggagcccgccaaggcgtcattggagacggtcaagttggcgtgacttcgtatgtcgtgccgaaaggggctatggcgttttgggaaaagagactagaaaagttcaacgttccctacaccaaaatcgagcgctttggggaaaaatatgtagaatttgatgatcctcatggactgcacttagaaatcgtggaaagagaagaaggagaggctaatacgtggactttcggagatgtaacgcccgatgttgccattaaaggttttgggggtgcaaccctattatcagcgcagcctgacaaaaccgctgaccttttagaaaacatcatggggctggagcgagtcggcaaagaaggagacttcgttcgttatcgttccgccggtgatatcggaaatgtgattgaccttaagttaacgcctattggccgcgggcaaatgggggccggaacggtgcatcacatcgcttggcgggctaacgatgatgaagatcagttagattggcaaagatatattgcttcgcacggatatggtgtaactcctgttcgggatagaaactactttaatgccatttacttcagggaacacggggaaatcctgtttgaaatcgcaactgatcccccaggctttgcacatgatgaaacacaggaaacaatgggcgaaaaactgatgctgcctgtgcaatatgaaccgcatcgcacacaaattgaacaagggctgctgccgtttgaagtaagagagttagattgatttgacacataaaaaataaagaaacatatattcaattgatgattgctggataccgtcagcaaagaattagataaaatcaaagatgaggagagatacaaatggaagatgcaggactgttgcttattcgtataatgattggtgtggtgtttttgttttatggcacacaaaaattattcggctggtttggcggatacgggattaaaggaaccggacaatggttcgaatcaattggggtgaaaccaggaaacgttgcggccgctctatcaggtcttggggagttagtaagcggaattctatttattttaggcgtattcctcccgcttggagctgctatcataacgatcatcatgttaggtgctatcgtaaaagtccatggagcgaaaggttttgcgaatggcgccggaggttttgaatataacctggtgctcattgcagtttccataggggttgcactcatcggttcaggagcttacgctttgcatttttaatacgaaagtatgtaagaacagttgcagcttgtcggtaactgttcttttattttgacattttcggcaagcttgcaggtactctgcaaagcaaaaaagcggatataataaatataaatctgtatagtgaatgatacgtattgatgagcttggtcatgaaaaacagacctatttgaaggagtaaatggatgaaagagatgacagaattacattcattagtttttatagaaaactttatcaaacagcacaaattcagttttatttatatatcaaggcctggctgttcagtatgtcacgcagttctgccccagctcagaatagtattggatcagtttccaaacatcaaattggggcatatcaatgctgacgatgtagcagaggtcgccggcagattttcagttttcaccgttcctgtgcttcttttgttcattgatgggactgagtttctaagagaagcccgttttgttcattttgaacagcttgaacaaaagctgaaaagggtttatcgattatatgaaggcgaataaagaaataaggcaaaaaaaagaactcaaatgagttctttttttttgcatcaatttattcttcactaggcgaagaagggttatcaacctgcccttgatcacttgtatcattatcacaacttgctgaaataataattgaatgagaaggagagtaatctcctaatgtgaaattgacaccgtaatttttgctgttcgcagtatggctgttttgcaagttatgtccgatatctgtattggcgttttgtgtcattccatttatcgtgagatttgagatgttgatttgagatcgcatgcttcaaaaactcctttcactcagaagtagccgtcatagaggacgctggcagtctatttacttctatgatattgcgtttttatatcattgcatcaacataatggtaaaaataatagcgagtgaatgagtctcttttgaagatgatcaacctatcagcagaaataaagccgcctgataaagaggcggcagatcgttatatgtcatctatgaatttgatgtatcgtttttcgtttgcctaaaggatagaatggtcgtttttaatgatgagtaggagcctatagcagcgtagccataaaaccagcccataaatacgccagaaaagaggctgtgtcgatggcttatgaaaacagaaatgacaaggcctgttattaaggcaactgacggtacaaaagttttggggattttcaataatattttgaggatttgggttatcaatatgatgattggaacagctatcacagcatcccaaaagttcgtgtgaataattggaaaagccatacggcacctcatgaagtgtttatttcttaatttttacgctaaaagcttggaaagcagctcttggatcgcatatgttacattttgggcttgattggcggagcttgtttggcttaaagtattggattcaaaaaccaaacctgtattactcccaccggaaccctctgttgttttagacacagagaacgggctgatggaaactgcaaatccgttattaaaaacgctgttcccggatatcgaatgaatataaactgggaatttcatcattcatctctcctctctgttatgactgtttatacaatatggtgtgtgagcagcagttgcttaaacaaaacggcaaaaactttcagtaagagacaaaaacctgcaaaatgccacaagcgccttttgttaatgcagctttttagggacgttttttttattttttttaccaacttcatcaaaaatattctgattgccagactgggcttgtccatccttatttatgaaatcggggtgaatgagttttttcagatccctgactgttaaaggcttggcgtcatcagttaattctattcctaattgcccgtttgcctctaatgtcgcaattttgacatcttgtatagccgtaacgccgtgaagccttagctgcatttcaagctggtcagctgtaagtctcatcttctttaagttttcgatatgaagctgtccgttttcaatgacgatttttgcttttccggttaacatcttttcaatggtgttcgatttcatttggatccattccataacgatgagtgtgcttgtgaaaattgccgctgcaattaatgttttgaagaggctgtactcgatgattggctgaacgataatagttccgatcgaaatcatgacaaccgtttgagttgacgtcatttgtgcgattgatttccttcctgaaattctcagcaaaatgaccccggctacaatgagaacaagagattcccaagtgaaattcatgctaccacctgaccaatgatgaattagatttgtcatgggattggcttttcttccggccaatcgcaatttaatatatccgaaaggcagtcggttcattctgtcctgaaccgaacaatatttttggtatagatggatatattaagccaaacaatgatagcaacaggagttttttggccgaaacaatctgggaagcggggagcgccataacatgattgaacttgaagttgtcattagaacggttgccagctttggcttgctgttaatcgcagaacgaattttaggcaaacagacaatctctcaaatgacgatttttgattttattgcggcgatcacactaggggctattgctgccggattagcttacaatacttcaataaaatcgcacaatatggccatttcgtttagtatttttgtgctaaccatttttctaatttcgtttctgtcgataaagaacaggaagctgaggaaattttttgccggagatccaacagtgctgattcaaaacgggaagatacttgaatcaaatatgaggaaaatgcgttacacacttgattatttaaatcagcaattacgggaaaaagaaatatttaatatcgaagaagttctttttgccattcttgaaacgaatggtcagctgactgtgttaagaaaaccgcaattccggcatgtgaccaaacaggatttaatgattgcggtaaaccaagaacaaaggcttccgatagaacttattatggacggagaaatcattgagaataatttaaagcagaatcgtttgacggaatcctggcttttggaagaattgcgaaaaagagacataaaggtgaaagagaccgtgtacgcagtgctgctgggtaatggggatatttatgtggatcaatataaagaccatatatcagtccctatggataaggaatgaaggaacaatcaatcttaaagctccttattgaacgcaatggtttcaacttgtcttgggtacgaaatatgcagaagcccgtttaacagctgaatctgtaacaaatgagtttcagcggcttcgggaagctgaatgattcgctcaatttctccgtaataccgttcacgcagcacttccatttcggctggaaaaacaggcgtgatcgttcctttgatcagcagctgggttttagacagtaaacggatcgttaattcttcctcatacacaccgggcatttccacaatgataaaattatattcctcatcttgataaaagtcgtaaacaaacgtagaagcttcggaatcaaaaaaatgttccggggctttatatttgagcacatttgtccaaaagtcactttgtttatattcattcgtaatctcaagccactttcgaattttttcgaaatccatatgagattctccttaaatttgatttgaaatcggcgcagaagggtttccgatttggtcttggtcactaacgtctgaatcaatatttccagtgttcaaaagtgaagacgtaggcgaaagatcccctaaggaaaagtttgctccaaaatatttgctgttcgcagtatggctgttgtgcacagtcggaccgacatctatatttccgttttgcgtgacgccgttgatcttaatatttgcgatattaatttgatatggcatagacgaaacccctttaatctaaaattggcggtggtgcaatcggaggagcattaacgttggatgtatcagagttgccgatagatgtctggtcatttacatcaggatcgtttaagaagttttccattacggattctgtaggtgatgtatcaccgaaagaagagttggtcccttgagatttttgattgttggtagggctgttataagcagcttcgcctattgtaattgaaccattgcccgaaatactgttgatcttcaaataatataggttgattactgtagacggcatcccatcacacccttccatctttctgtacagtacattatgcgccgctgcacccaattgttccttgcatttacgggcaaaactctatctggccctggagtgatgctcgttagaaaaaaagaataaagtttgtcacagcctgaatgtcaatctatttggcaaatacttatcagtgaatgaaaagccattgatataggaagcaatgaattgattcagttattcgaaatgcatgagaccctttaataaagaaagctggcaaacaggatcagtttgaaattattgacaatgaagcaaatgccatgaaataatactcgtgagtaacattacttgcgagtattatttttgggggtggtcctcgttgaaaagtaaaaaaggacgtaaaggggaagaaagccggaaacggttactcaaagctgccgctaatgaattttcgattcggggattccatgacgcgaaggtaagtgaaattgtgaaaaaagctgggttcacgcagccttcattttacctgtactttcaaagcaaagaagccatctttgccgagttaataaccgattttcactctcgggtcaaaaagctgacagagtcacttcttctggaaaacggattaaacacggaggatgtgtcaaaacgggtactgctagctgtagagactgtttttcagtttttggctgaggacaaggatttaaccaagatcggcttttttctcaacccggaagcaaaacaaatgaaaaaagacttggcgatggttttgaaagagaacttagaagcagaacagcggcttggctattttcactctgaactggatatggaaactgtcgctgagtgtttggtcggcatgattgaacatttaaccgattcatttttgttaaccggaatcaaagatccggcaagcctcgcagcagaggttgtgaatcttttgatatacgggatgcttccgaaagggaatgacgtaagatgatatctattattctgaaagtcagtttggcagtttttatgcttgcgggaggcatcataaaggtaagccgcgttccctttcaagttgagcattggcggcattatcaatatccattatggtttctgactgttactggcattcttgaaatagccggggcacttgctatgacagcgggaatttggaatcggtatgcagcgattggagcaggtgttctgtttgtcgttctcatggcgggagccattcatgcgcatatgtttcgagcaagacaatcggtcatcatggcgataccagcgatgatttgtttgattgtttctatcatgatcatcatggggagttacacgtaagcttttcactaatgtttaagaacaagcccatttgcaggaaacctcctgttcttatcgaataatagaaagtccaggaattaactgaagcagtaaaatagagatccatttctgcgttattcgtccggcatcagctgggctttttttataaaggaggaatacaggatggcattaactttggaagacatgactgaggaagagttcgaagcctttcgcgggatgtccgtgcaaaattttgcgaaacaaaacataacttcaggaacttggacggaaaaagaggcatttgagaaatcggagcagacatatgagaacatgattccgaatgggcgagacagcaacaatcattatttttggaacatcacaaatgaccaaggggaaagaatgggctggctctggctgtacgctgatccgtttcatccgcaaaaggaagcgtttatctattcctttggattgtatgaagcctttcgcggaaaaggacttgctcaattggcgcttcaaacgcttgatgaaagagcaagagagcttggtgcggaaaggctggctctacatgtatttgcacacaacgagacagccgtctatctttatcagaagatgggctatgccttgaccaatatacgtatgcggaaacagctatgctgaaaagtcgcttacgttacccaaacacaagatgcctatctggaagcagtggcagggtactataagtcatcattagaaacattaaggtcatgggaaggcttgaacatataaagaaaaaaggacaacagctgttgtccttttcaatgccgcttgaactttctccctcagtcttttttgtcttgatgatccagctcttttattcgtttcgtaagctcattgaaagcctgatcaagctccttataccctttatcatttggcgtcataaaactgagctttcccagcacttcttgtctttctgtctcaagctttaaccgaagctcctcccgctcatttctttctgaaggagcgtcgtttaactgcttttcgatgccgttgtttgagatgacgagtttactgtttgttgttttttcgagaaagtatcggtcatgtgaaaccgccagcaatgtgccgctgtattgtgacagtgtttcttccagctgttcgcgtgacggcaggtcgagatggtttgtcggctcatctaaaatcagcacgtctttttcctccagaatatatgccatcagcttgatctttacacgctcacccatactcatatgcttgatcggttcagtccattggtcggctgtaaaacctaagtgcctcatcagattttgaacgtgcccccttgctttgaatgtttcattctcaaataactcttccggtgtttgttctaaaggcaaatcaaacacctcctgcgttaaatagccgatgtttgcggacggcgacacccatacgcttccttctgctgtttcctgtccaagaatgatattcagcaatgtcgtttttccgctgccattggggcctatgatcgcaaccttttcgccgtgctgaattgtaaagtttgcgtttttaaagagagtcctttctccaaacgcttttgttacattctgaacttctaaaaaccgtttccctgttttgtgggttgtatcgattgaaaagcggactgtatattctggggtaacgggttccgcctttgctttttcaagctctttttcaagccgcttctgcttggattttatctgggcatccgtacgcttcgcttttacccggtgatattctttaaacccttcctttttcgtcgattgagcatgggctttttccgaccaagaagcgagctcattcatttgtgcttcaatccgttcaaccattttttgctgcttttcatattcacgctgctgggtgagtcttttcttctcccggaacttcatatacccggagtaattccctttgaattcaatcagcgtctgatcctcaagcgaccatatttttgttgcggcttcgtctaaaaaatatcgatcgtgagaaacgagaatcacagtgccgttataatgtttcagctgttggatgagaaattgcaagcttttttcatcaaggtggtttgtcggttcatctaacagcagcagatctgcatcctctgatagtcctttcgccagccgcgcttttagtttttcaccgccgcttaactgatgaaaatcacgaagaggcacatgccatttctccagtaacttcttttcggcaggtgtctgatccgcaaaggaatatgccgctgtttcctgttcaaccaaagccagttttatatcctttcgaaggatttgaccctgggaaggggctaagtcattgtgaatgaggtgcagcagcgtagatttcccagcgccgtttttgccgataatcccaatgatatctccttgctgaacactggcatttatatttttaaaaacagtcagatccttcacttcatagctaacgtttgttaatgttacgatctctttcatccatatccctcgctttaaagggagaataaaaaaatcctcccaaatgtgttggaaggattagccgtgcctgtgcatgatcaaataagctattttttataaatagcaggtcgtatatatagaaaatgggcagactaatcctattttttgatttgaaatattgatttcaaacgataaaaataagattagttaatcattgtccacccatcatcccttcttgttttgattacaaacactatagcataccttcaaattcaaaagcaaaggtcattttcatcaaaaaaactcctgctctcatttttgaggcaggagtttcgagtgttattgatgcttcgcttttctcactttataaatcacaatcagcaaaataaaccaaaccggtgtgacaaataaggaaacacgagtatcctgtgccagtgccagcacaaccagaacaaacgccaggaacgcaagaatcaggtaatttgtaaacggataaagcggaagcttaaacttgtttgttttcgctaattcaggtcttgttttgcggtatttcatatggcagatgaccgtaattccccaaatgtagataaagcatacggttgaaatacttgtgatcagggtgaatacgccttctggcatgatgtagtttaacgtaacaccgattaaaatcacgatagctgaaaagaataaagcatttcttggcactttacgctgagtcagtttcgccattgactcaggcgcattgtgatctttcgccagggaatagaccatacggcttgtactgaatacagcgctgttgcatgctgaagcagcggaagtcaatacaacaaagttgataatacttgcagccccgacgatgccaaccgcgacaaatacttgtacgaatgggctttcgctgggattgatgacatcccaaggatagatgctcataatcacgagaagagccccgatataaaaaagcaacacacggacaggaatattgttgatcgccttagggattactttttcaggattttctgtttcaccggctgtaagcccgacaagctcaatgccgacaaaagcaaacacaaccatctggaacgagaggataaacccgtgcatgccattcgggaacaggcctccgtggctccagagatttgtgaagctggacactcctgagcttgtggaaaagcctttgaaaatcatcacaaggccaatgacgattaacgccaaaatggcaatgactttaatcaaagcaaaccaaaattctaattctccaaaaagcttgactgtcgccaggttcataatcagtaaaataattagagcgattaagccaggcacccattgcggcacacccgggagccaatattgagtgtagagcccgactgctgtcagatcagccatcgcaatggaaatccagcagaaccaatatgtccagccggtgataaatgctgccatatcgcctaggtagtcttgtacaaaatccacaaaagagtgatagttcaagtttgataacagcagttcacccagcgatctcataattaaaaagcaaatgatccctgtgatcatataagcaaataaaatcgaaggtccggcaaaatgaatcgatttgcccgagccgagaaataagcctgtcccaatggctccgccgatggcgatgagctggatatgcctgtttttcaagcctctctgcaacgtttgctgatttatattgtctttcgtcatgtcgtctgtcactttatgtgttcctccattgaaaattgtttattgagtcagcaatctatttttaatgattattataacactaaaatttctatcttttttactaaaaaaggattgatgaaaagaattttaatgtgatttggactatttcccgaaaaaagcggctccatttagggagccgcttttttatgctttttcagtttttgtcataaacaggtagagcccgtaatctgtcggtgcggatgcgtagcctgcctgccgcagcattgctgtgatattgccacggtggtatgtcccgtggttgacaacgtggggaagcagttcggaaacagttgttttcatgattccgcttgagggattctgaatctggagtggcttattgagctgttctttttgctgtaaaaatagtatatagcgctcggataacctcagaaaaaggtcttccatttcctctatttctttagcctctgtctgttctttaagctgttcagctaaagccaacgcatcgctcaaggttttgccggaaaacacttcaatccagccgagatcagaaagataaacatgagacaatacatgggatattgacggaaacacgctttgaatttcttgatggtatacctcttttggaagctcttttaatcggttgaatatttgttgattggcccagacgttatattcatacaatttgaatgcaaaatctgacatgttaaaattccccctttcgtgtgtatagcttccattatacacgaacatgagttcttatgtagagtgctcaaaaataaaatttgttgacatatatagtttagaggaataaactaattgacattgaacataaagtttagcggggtaaactataatgaggaggggaagatattgaatgaacaaaagctatgtcaggcgataaacctgtttgtggaagtcctgcttgaagggacagaatttgtacatcgtgaaatcaatcaggatgtcttcaagcatatctcaagggaacaggcagacctgttgaaaattttaaaagtcaagggcccaacctctcccggcagcctggccatgtaccaaaatgtacataagagcgcgatctctaacagactgaaaaagctgctcgaaaagggattggttcaatgggacgactgtctggaaaaaagtgataggcgctctaagcttattaacattacacccagtggtgaacacatactagaagaattagattctgccatctttaacgcgctcaaaccgctgattgatgatatagatgaggaacacttacattccatcatcgagatattcaccattttaaaaagcaaatttaaaggaggagattctgccgaatgagagcaatcatcaaattcaagtgggcaattgcagccatagtattagcacttaccgtcgttttgagtttgttttctccgaacttaacggagctggccaatcaaaaggggcaggcccagcttcccgctgatgctgtttcagaaagggcaaacgccattttaaaacaagcgggagaagacaataattcgatcagtgttgtctttacattagacaacgctataaagaaagaaacagagaatcagctccggataatgattgataaaatcaaaaagatcgacggtgtagaagaggtaacatctcctctgtcagcggaaaaagaagtcaaagaccagttgatgtcgaaagacaagaaaaccgttctcatgcctatcacgattacaggttctgataaaaaggcggaaaaaattgcggacgagatttatcaaatcgttcctgatgacttgacggcatatattacgggagcttcccttatcaaccaggatttcgctcacagctcagaggaagggcttaagaaaacggaagtgatcacagtctgcctgatcatcggtttactgttgatcgtgttccgatctgttgtgacgccttttatcccgattgtggttgtcggtttttcttatctgatcagtcaatccatactgggcatccttgtatacaatgttgattttcctatctcgacgtttacgcaaaccttcttagtcgcgatcttgttcggcattggaacagattactgcatactgcttcttacacgattccgtgaagaattggcaaacgggcatgataaaaaagaagcggcgcttatcgcttaccgtacagggggaaaaaccttatttatcagcggttttgcggtattgatcggattttccgccttaggatttgcgaagtttgcgattttccaatccgcagtaggggtagcagtcggtgtgggaattttaatgattatcctctacacactgctgccattatttatggtgacgctgggtgaaaaattattctggccttctaagaaagtgctgtcacacagtgataacaaactatgggcgtttctcggcagacactccgttgcgcgtccgtttctgttcattgtcatcacggtggtgattacgcttccgttcatcttgacctatgatgaccagatttcattcgactcaactgcggaaatcagcagcgattataaatctataaaagctctcgaggccattaaggatggattcggggaaggaaaagcgttcccgatcaatgttgtcgtaaaaggagacaaagatcttacaacagctgatacaatcccctatctaggaaatatcagcaaagcgatcgagaaagttgatcatgttgactctgtgatgaccattacgcagccgactggtaaaaaaatcaaagatttatatattgataaccagctaggatcggtttcagacgggctggataagacggtaaaagggattgccgatgtccaaagcggattaacggatatagaaaacggactgaatcaaatggcagggcaaaccggctcggcctcaaatggagggtctggcggttcactgggcgatgcggcagatggcttgggcaaaatcaatcagcagctgcagctcgtgagcaaacagatttcccaaaccggcaataccgcacagaccgtgcagcagcttacggcaatcagcggacagcttggccagattcaaaccggtcttgaacaagcgaaccagcagctctcaggccagcaggcacaagccggaacgctgacagaaagcctgaagaagctgtccgaaggcgtgaaaagagcaaatcagggcctgacgaaagtctctgacggtattacagcttccagtgatatgttagaggatatgagcaaaagttcaactgtaagagatacaggcatattcattcctggtcaagtaatgaaggacaaagactttaagaagtcaattgaccagtattcctttgcagacggcaaaggtgttcaattaagtgtcgttctggattcaaatccgtactcagaacaagctattacgacaataaaccaaatcaaaaaagctgtcgcaaacgaagttgacggcactcctttggaggatgcacagatcgtatacggcggggtcacgagtatgaatgcggacttaaaggagctgtccacaacggacttctccagaacaatggtgattatgattataggcctgtttatcgtgttaaccattttgttccgctcaatgatcatgccgatttatatgatcgcgtcattgctgctgacgtactatacgtcgatatccataacagaattaatttttgtaaacggcttaggaaacgcgggtgtcagctgggcagtgccattcttcagctttgtcatcttgatcgcgttaggggtagattattcgatcttcttgctggatcgatttaaggaagaggtgcaccttggcattgagcaaggtgtcgtcaggtcaatgagcaaaatgggatctgtcattattacagctgccattatattggccggtacgttcgcggcgatgatgccttcaggtgttaatacactgatgcaggtggcaagtgttatcatcatcgggctcttgctttacggccttgtcattcttccgcttttcatcccggcaatcattgcgacctttggagaaggaaactggtggccgttcggcaggaagaaaggaaaagagtaatcgagagaagagtgatgaatggtcatcactcttttttcatgatctaaacgacgaacttcagacgtgttacccaaaaaaggtcagacgatcaaacggcggctgggtacttaaaaacaaagagcccggaaaacattcccgggctctttgttttatttccattctgcaattgtatcaatcggcagacggtaggaagcatagccttcgtctgctgcttttccgatagaaagtagcataaccggtacataacgttctttatctaatccgaaggtttccgcgatgttttctttatcgtatccgccgatcgggtttgtatcgtagccatgcgcgcgtgcagtcagcatcagctgcatggaaacaagacctccatcaatcaggatcgtttcacggttgacctgtgccggaagcttttcaaaatgtgcggtcagcgcggcgatttgtctgtctttgacctcctgcggcatgtaaccaagttccacggcttttgaatagatttcttctaagtagtctgcattgttcatgtctgcaaatacagcgatgacagcagatgatgttgtgacctgtgtttggttaaagcttgcaagcggtgcgagcttttcttttccttccgggctgtcaatgacaagaaaacgccatggctgcgcgttaacagaagatggggcagttgttgcttcctctaagatctctgtcatttcttctttgctgatttttactgccggatcatagttgcggatagaacggcggcctttcataatttccataaaatcgtttgttttgatcatgttgatacactcctcttaagcttcgatattatttatattgtttcgcatgcgcgccagcacatcaatgagcaggcggcgttcttctgcgcttacatttgcgagcatttccttcatgaaacgctccttttccttcttagaagactcaattcgctctcttccttggtctgttaaccgaacaagggtgatgcggttgtcctcaggcttgcgccgccttgataccatgcctttggcttccagctgtttcaggtgtctggtaacggctgcgctatcgatatttactttcttttgaaggtcgctttgactgatctcatctgcatgataaagcaatgtcagcaattccaaacgagattggctgatgcccgtgcatgcctcgaacttcacgccaatcaccttgttcacgccttgcagctgatataaaatctcggcttcctctgaacaaaatgacgccaaaacccatcccttctttcctgtcaaaactattaattgatatatcaatgattgacacgtcaattaatatacaacgattgatttcatcttgcaagccatttgcacttttgaacaacctcccagcgcataaaattcgctaggctagaacttagcaaaaaaagctggccgcttcttcagatgatgctggtcacgatgattccctgcatcattcccatttataggtgttcggaatatcactttgccgagcccgtgctcaagcggctttcacaggctgaaagttatgatacaatatacaaatgtttcacagcttcaatccatagttggagctgacatccattatataagggactaggttgaagggaaggtttgataacatgctgcacaatccaactggaaaagaacgcttggcactagcgtttctgctcggcatgcttgctatattgggcccgcttaatatagatatgtatttgccaagttttcctgaaatcgcgaaagatttatcagcaagtgcttcacttgttcagttaagtttaacagcctgtctggtcgggcttacgatcggccagctgattgtcgggccggtcagcgatgcgcagggaagacgaaaaccgctattaatctgtatttttttatttgcgttatcttctctgttttgtgcactgtcgcccaatataacaactttagtggctgcgcgttttttacaaggcttcactgcttctgcagggcttgtgctgtctcgcgcaatcgtccgcgatgtgtttaccggaagagagctttctaaatttttctcgctgttaatggtcattaccgcggtggcgccaatggttgcgcctatgacaggcggtgccattttgcttttgccgttcgcaacgtggcatacaatttttcacgtcttaatgatcatcggatttttactagttcttctgattgcattgaggttaaaagaaacgcttccgctggaaaaacggattccaagctcaatcggaacatccgtcaaaacgatgggcagcctgctgaaggatcgatcctttatggggtacgcgttaactgtcggatttattcacgggggaagctttgcatatgtgtctggtacgccttttgtataccaggatatctacggggtgtctccgcaggtatttagtattctttttggcattaacgggttggcgattatatcgggcagctttatcatcggacgctttggcggaatcattcatgaaaaaagcctgcttcgtatagcggtcattacggctatgattgcgacggctgtgctattaaccatgaccatgattcacggtcctcttgctacattagtcatatccattttcatttacatgattacgatcggcatggttctgaccagcacgtttaccctagccatggaaaagcaggggcaccgcgccggaagtgcaagtgcgctgcttggaatgcttccgctgctcctcggttcaatcgtgtcaccgcttgtaggcattaatgagacaacagccgttccgatgggagccatcatgtttgtgacagctgtcatcggctcactggcgttttttggattaacgaaagaacgagtagggcagaattcataaaaaaacctgacatgacgtcaggttttttgttttatttagaataacaacagcaggcctgcaatcgccggagtcaaaaagatggctgatttcaaaaccacctttggcatgaggttggtgaatttcgcgcctacataggccccgcacattgtcccgaccagaactttgacaagtaaaacgtaatcaacaaaaccttctgtaatatatccgatgcctccacctacagccagagggatgatcacaagcatcgtcgttccgacagaatggcgaatggacagattcagcataatcattaaaccgatttgaataaaaggtgccgacccgatgccgaatgtgccggaaagaacgccggctgcaattcctaagatgaccgctctcgtatacgttgaaagagtgctttgattcacttgagccttctcttttaaaataaataatctgattaaaatgagaattgctgataaaaataacattccagccgtcaaataatgaagcaaatcagccggaataaaagaagtcagcttggcgccgaaaaatgagccaaccgcagcaaagcctccgactattaagccgattttcatttgaatgttaccctcgcgatagtggctgtatgcccctgataagcttgtaaaagccatgccggcaagcgaagtgcctaaagccgtatgaatcgggatatggaaaagaagcgttaaaagggcaatgacaaagccggctccaccggcgccaataaagcctaaaataattcctagaagaaacataacaagaataatgagcatattttttcctccattgaaaagatgtaaaaaatgtaatcgtgcgctattctggcggaggtatggtgtcctattgacgaagaaaaacacgccgttttttcagttgccagtagtccgtcgaccgtcgttcagcaaacatatcgtacctcaaattctgggatctgacaaggcagtttgttgcttcccattaccatctgttatatgattttgatgaagaaaagcccttgaatatattcaaaagaggtattatatatggacgattttaaattagataagccgactccctactacctgcaattttataaccagctaaaaaaaatgatcttcaacgggacttttaagcctggggaacggataaacgaaacacagctggcgaaaagctttggcgtcagccgctctccgataagggaagccatgcgattgcttgagaaagatggtttgttaaaagcggatgaccgaaatgggttttcgatcacgtcgttaacggcaaaagatgtagatgagatttataaaatcagaattccgctggagcagctggcagtcgaattagtcatagacgaagcggacgaagaagagctgaccatactcgaaaaacagcttgaagaaacagagaaagccattcacaacggcacggaagatacggaaatcattcgtttaaaccaaaaatttcatgagctgctggttgatttcagccataacagacatttgaaaaatttgcttgagcatgtaaatgacctgattcatttttgcagaatccttaattataccggcgaccaccgtgcagaaacgatactgcgtgagcaccgcaggatatttgaagaagtgaaaaagaaaaacaaagaagcagccaaacagcatgtgctggctcatttcaatcatgactgtgagcatttgaagcatgtgcttgaagaaggtaaagagaattgatttgtatgatccggtaccaagggagagcagaacccttggtatttttttatgtattcaccacatatctaagaggccccgttaataagattttatgatggtttgactaacgaataatgggggttaaacatgtttatccatatcgtcgggcctggtgattctttgttttcgataggcagaagatacggtgcttctgttgatcaaatacggggtgtgaatggtttagatgaaacgaatatcgtgccggggcaggctctgcttatccctctttatgtatatacagtccagccgagagatacgcttaccgccattgcagctaaagcgtttgtgccattagagcgactgcgagcggccaatccgggcatcagcccaaatgctttacaagcgggagcaaaaataacgattccttcgatctcaaattacattgcggggacattgagtttttatgtgctccggaatcctgacctcgatcgggagctgatcaatgattatgcgccatactcgtcttcgatttcgattttcgaataccatattgcatcgaacggcgacattgcaaaccaattgaatgatgcggctgctattgagacaacttggcaaagacgggtcacgccgctggcaacaataacgaaccttacatcaggaggcttcagtacggagattgttcaccaagtgctaaacaatccgacagcgagaaccaatctggtcaacaacatttatgacttagtttccacaaggggatatggcggtgtcacaatcgattttgagcaggtgagcgccgcggatcgcgatcttttcactgggtttttacgccagctgagagatcgccttcaggcgggagggtatgtgctgacgatagctgttccggcaaaaacaagcgataatattccctggctgagaggctacgattacggggggataggagcggttgtcaattatatgtttatcatggcttatgattggcatcatgccggaagtgagccgggtccagtagcgccgattactgaaataaggagaaccattgagtttacgattgcgcaggtgccgagcagaaaaatcattatcggagtcccgctctacgggtacgactggatcatcccgtaccagccgggcacagttgcttcagcgatttcaaatcaaaacgcaatcgaaagagcgatgaggtaccaagctccgatacaatattcagccgaatatcaatcaccgtttttccggtacagtgatcagcaggggcggacgcatgaggtatggtttgaggatgtcagaagcatgagccggaagatgcagatcgtccgcgaatacagattgcaggctattggcgcttggcagttaacgctgggctttacaccgggcccatggcttctgcggaaattttttacgatcagaaaagtgtaaaaaaagacaccacaactggggtgtcttttttttgattaagtccagagcagcagaatagttcattcatttgtaccttgcataggttgtgttcccattttacgattagtagtagtctgatcaaacaaagagtcagaatacgatttgagagggagttgtctacatgaagacagtattgattttgaattttcctgcggaaggccatgtgaatcctaccttaggcattacaaaagcgttttccgataagggatatgatgtccattatatatccactgaaaaatataaaaaacgattagaagcagcgggagcaacggtccatcttcaccgggatctgctgcgaacaacacctattcatgtcggttcgcccaatggcattcttgatttcgtgaaaatccatatcaaaacgtcattggacattttacagattgtcaaagacttatctaagagcattcaatttgattttgtttattatgataaattcggcgcgggggaattggtaagggattacttagatattccaggagtctcttcatcggcgtctttcttgtttggcgaggagcacctgaaaatcctgccgctgcatccggagtctggagcgccgcttgaattggatcaagagtgtgaagatcttttggcaaaaatgaaagaaacgtacggtgttgccccgaaaaacctggttcaattcatgaacaataaaggggaattgaacgtagtgtatacaagccgttattttcagccagaaagtgatcgtttcggggatgaatgtctgtttatcgggccaagctttccaaagagagcggaaaaaacagatttcccgattgaacagctaaaagatgagagtgtcatttatatttcaatggggactgtactggatcatacagaggatttcttcaacctttgtattgatgcattttcaggctttaacggaaaagtcgtcatcgctgccggagaaaaagcggacctgaccaaattaaagcaggcgccggaaaactttatcattgctccgtatgtccctcagctggaagtgctggagcaatcggatgttttcattacacacggcggaatgaacagcgtaaacgaaggcattcatttcagcgtgccactggttgtcatgcctcatgacaaggatcagccgatggtggcgcagcgtctctctgaactccatgcaggctatgtcatctctaaagatgaagtcaatgcccaaatattaaaacaggccgtagatgaggttttgcgcaaccatcagtatacggcaggcattaaaaaaatcaatcaaagcttcaaggaatgtatggacatggaagaagtgatggagcgggttgatgagttgattcgccaaaaaaacaaataagaaaaagaactcccgtaccttgtacgggagttcttgatttaaaacttgattttgattttttgagcatcactgattttcttatggttatggtcaaagacgtcacttgtcgtgatttcgatccacttgatctcttttgttttcttctcagcatccgcggccttatcatgagcatggcggcttgatgcgttcacaataaagccgagatttccagacttttcggcgccgccttccaattcgccgtttaactcttcaagataaatatctttgttccaatcaaaggtttcgcccgtatttgttttcatcaatgcaatcggcgcaacatttactttttttgaagaggtgttcttgatatcaacgaaaaccttaacgaaatcaaactcttcatcgtgtgttaactcatgaaagtaatcaatcatgctgtagtccgggcgcaagtggatcagcttcatttcttttactgttaactccacgtcgccaatcttataggttttgttcacttgtttgatatcttttaagacagcttttcctttatcatctgaaaacgtttggccgaccttaagcaatgaccggtcatcagttacctgggaattaggctgataattatctgtgctgtccttctgggatgaagtgctttgcggctcagcttttactgttttctccccgcctgcatgctgtttttcagtactggcgtttgatgagcagcccgcaagcatgatagcaaaaacgaaaattgaaagaattcttctcatgatgattcctccattaaaaagagatcccgttacttcatacaagcaacgggacaccttgtaatcttttacttatcgttaatcttaatgttgtattgtaaagccttgaagacatttttggcgatttctgtattgtcgatttggccggcaaatgtctcactagacggaccgtatgcatagacgggaacatcttcaccggtatgtccgcctgttgtccatccagtgtgagagcgtttattaaagatgttctcgattgcgttatcgatatccagtacttccttcgattttgccgcttcttcaacagattgaatttcggcttttgttaaagccaatttcttttgatcgatatatgttttcaaagttttttcaacatccgcgccgtcagagatcttttctgccataaagtcaggtgtgcgctttgcggctttaatgggttcactgaaccagttgtagatgccgtccgcaccgatggaatatccgccggttgagtggtcagccgttgcgacaaccaatgtgtgcttgtcttttttagcgaaatcaatagccgccttataagcttgttcgaagtcttccatctcgctcatggcaccgacgatatcattgtcatggcccgcccagtcaatctggctgccttccaccatgaggaagaatccgtctttatccttgtttaattttttaatggctgtgtttgtcatatctttaagtgatggaatatccttcgtccggtcaatctttttaggcaggccgccgtcagcgaataggccgagaacttggctgtctttatttttcagcatgtccttgcgatcatccacgtagctgtaccccgcttttttgaattccttgatcaaattacggtccttacggtcaaaattgctctttcctccgcctaaaaggacatcaattttgtgcttgccgttgaccatctcatcaaaataatcatccgcaattgagttcatattttttcggctatggtcgtgtgaaccaaaagaggccggagtggcgtgtgtaatttctgaagtggccacaagtcctgttgcttttcctttttccttcgcagcttcaagcaccgttttggcttctgacccgtcgttatcaacggctatggcattattgtatgttttaattcccgcagacatagccgttgccgccgctgcagaatccgttacattttgttcaggatcatcgggataagttgtttgctggccgacaagatactgatcaaaagccgtaggctccacaacttttgtctttttattatcctttaagtatcgataagcggacgtataagacacacccataccatcaccaatcagaacaataacattcttaatttcgtcttggtttccctttttcttttcctgggcgctggcatcaggcacactgccgctggctaagctgctgaacgcaattgatgataaaaccgcgataggcagtaatttcttcgggaattttttcaactggataacctcctaaatatagatgaatctcaatgacaacccaattatatttttaaactgttaagctagtattaatcgattttaaagattggatttacaagaataatgaactgctatcaagagaaaggaaagagtgatagtactatagaaataaattggaggaatagatactggccgtggataggcggactgaaatctgctatagtcgcatagaagcaacccgcttacatctggaacaattttaagtattatgttggaaagaggtattgtgtaagcacatgtctgagcagttcatatggagtggcatcattttattttaggagggaacaacatggacgttttttctgagtatttagcgggaattgatgacccgttccaccgagaaagaacggaagaggtgttaacttggataaaaaataaatatccaaatttacatacagaaataaaatggaaccaaccgatgtttacggatcacggtacatttattattggctttagtgtttctaaaaagcatttagctgtcgctcctgaaaaagtaacgatagcgcacgtagaggatgatattgtgaaggctggatatgattacaccgagcagctgatacgtatcccttggaatggtccagttgattacacgctacttgagaaaatgattgagtttaatattctggacaaggcggaatgctccactttttggcgaaaatgaaggaaaaaggcataacatatgagctgtataaaatatgttacgccttttcatttgtctatttttcgttttgatcatctattgctgcttttcttcaaacaaggtcatttcattgagcgtaagctggctcgcagaataatgattaccttgtttccatttcacttcaatcgtaatatcatggccttcaagctcatgttcatctaaccgctctaaaaaagaaacggacttttcctttgcgcttccatcacgataagtgcctccagcataatcatgcatcgggatttccgtgtcagaactcagcagaatttcatcatccttttttacaatcagtgattccaaataagtgttgtctgtttcatgtggttcaccgatccaataaagttcgccgctgtattcattcggtgcatcttcattttttttgaaaacagcttcccaattctggtctttgctttctccctgccaattcggatactccaaacgaacatgatgaatcaggtgataggaaaaaaagatcaagcagagagcgattaataggaatgccgtgaaaatgagagggtatttataatgactggacataaaagactcctattcgtttaatcaattaccttcgaaaatagaatttcatcccgaatcaaaatgccgttttcagccacctcgggaatctccggcttgagtcggcgcgctttttcaactgcgttcggaaacacttcggcgaattgatagcctctcttttgataaaacgccatcgcatgtacattatcattcgttgtaataagctttattcgttgacaatgtgcatatttagccgtctcttcaacctgctggagtaaagctgtgccgattcctttattttcaatcatactatctaatgaaataatttcacaatctttcccatctatcaagtatgtaatacagccaatgatttcgccgctttcatttactgcggcaaatccatctaattcatcacaccgaaaaatgccgctggaaatcgccatctcgggtgtaccccaatgcttggcaaaaaaatcggtcaacatctgtttcgctatctcattgtttgggatgatcatcatcataacactcctctattgaaagattgcatatgtactatcaatataaacaatatataacaaaaaaaatagatgttgaggtgacggcatggaaatcagcgatgtcatttacgggcaccaccatatagacggagtgctggaagagcttatcaaaagcgctcctgtgcaaagattaaaagggatctatcaaggcggagcaagctttttagtcaatcgaagatggaatgtgaccaggtatgagcactccatcggcgtaatgctcctcatcaaaaagctcggaggaacgatagaagaacagattgcaggtctgctccacgacgtatcacacacagctttttctcatgtggtcgacgttgtctttgaaaatcaagcagaagactatcatgaaaacatctttcaacaagtcattgttcactctgaaatcccggacattttacaaaaacacggctatcatactgaagaacttttatctgacgattcaaggtggacattgctcgaacagcccgcaccggagctgtgtgctgatcggacagactatacgctgcgtgatatgtaccgatatggacacattaacctgcacgaagcgcaaacctttttggatcatcttattgtgagaaacggaaggatgtttcctgatagtattgaagccgccgaatggtttgtcagtgtgtactacaaggaagtaattgatttctttttgaatcctgtgaatgtatatggatatgaatatttagcgcgagcattgaaggcagcgctgcggcatgatgtcatatctgcagaggatctgctgaaaacggaccaagaggtactgaacatcctgcgtgcatcaaaaaatgaagaagtcctgagcttgcttacatccattcatcccggcatacaagtaatagaggatgacatccagtacgatttccatcaaaagaagaaaatgcgcctaatcgatccatccatttttcttgatgacaaatggatcaaatcctcagatgtttctgaaaaggtgaggaaaatgggtgaggccgcttatcaaaaagcaaaaaaaggtgtgtatataaaaatcttaaatcagtaattgccgcctgacagcggctttttttatgtttggctttgcaaacaaaggggaataggacaaactgcgggaacgcattatgagaatatcagcgtatttacataccgttcgggggtatagtattatcgagagggcatgttttcattgtctgcgggcaaaagttacaggaaaaaaatgaagcaaaggagaatgaacatgaaaatctctaaaaatgcactgggaattctgatgttatctcttgtttttgttttatcagcatgcggcaataacaacagtacgaaagaaagcacacatgacaatcattcagactcctcaacacatgaagagatggaccattccggatcagctgacgttccagagggattacaggaatctaaaaatccgaaatacaaagtaggcagccaggtaatcatcaatacttcccatatgaaaggcatgaaaggtgctgaagctacggtaacaggtgcctatgatacaactgcgtatgttgtttcttatactccgactaatgggggacagcgtgtggatcatcacaaatgggtgatccaagaagaaatcaaagatgccggagataaaacgttacaacccggagatcaggtgattttagaggcttctcatatgaaaggcatgaaaggagcaacagccgagatcaactccgcggaaaaaacaactgtatacatggttgactatacatcgacaacaagcggcgaaaaagtgaaaaaccacaaatgggtcacagaagatgagctttcagctaaatcataaaaaatcctccttttacaaggaggatttttttgctgtctgaacaggtcttgttaaagaaatgaaagcaaacaggacagcgatgatcacaattgacccgccgcaccatgctgttgacaccacagtacccgtttgatccaaaacaacaccgccaatggctgagccaagggcaattccgacttggagggccgatgtgttaaagctttgctgaatgtcagacgaatcaggtgcaatttcaattaaatagctttgctgagccggggcgaggctccagctcagaagaccccaaatcaccatcacaggcaaaaagaaaatcatagacgatgtagacagcggcagtaagaacataatgatagcaaaggaaccggtcaccagcaaaatgctcttaaaggaaccaagccggtcagatagcgctcctccgaaagggcctccgcatacggcagatatcccgaaaaggaaataacaaatgctgacccagaaagagctcaggtgaagagtctcttctaaaaacggcgcaaagtaagcgtatagcgtgtagtggccagctaatgtaaacatcgtgacgaggtgtgaactcgcgattttcagattaccgatcgtcttgagctgttcccggaaaggaatcattttctccgccggtattctttcaaagaagattgaaataatcagcatggagatcagcgccaacaggccgatgccaaggaacaaaatccgccacccgaaggaatcgctgattaagattccgagcggcacacctaatgcgatagcagagctgaaacccataaaaataattccgattgcgcgggctctgtattcaggcgctacaattttcggggcaatcgttaaagaaagtacaacaatcagccctgtactcatcgccgccaataccctagataccatcaatgttgcgaaattagggctgaagtaggcgacaagattgctaaggaagaaaacaaataaagcaattagatataagcgcttccgctcaatcttcgcagtcaatgccaaaagcagcggcccagatactgcatatcccagcgcaaacacactgatcagctgtccggctgaaacaatggaaatgtctaaatcatttgcgatctgaggaagaattccccccacaattaactcaaccaatccgactgcaatcgtagaagctgcaagcaggaaaactttgaaattcataacaaactcctttacttaaatgttttgataaataaaaaaaatcctgattacaaaaaatgtcataaacaaattttgtaatcaggattttacggttcctggtagacaccctcaaaccatattattgaggttatacaagtgttaatagctatttaattgattcgtttccgttgatgagtgtaccacattatgaatgaatcttccatagaaaatttacaaagtaatgaaccggacaagtgtatgattatatttattttataaaagtatagacatttaaaagtgaatgactataataatcaatgtaagcgttttaattacaaggggggatagcagttgaaaaaaatattactcgcgtgcagttcaggaatgtctaccagtttattggtgacaaaaatgaaggaatacgcacagtctatcggtgaggaagcagagatttgggctgttggccaagataaggcaaaagaagacatgagaaaagcggatgccgttttgatcggtccgcaaatgagctttctgaaaagcgagctccaaaaagaagcagatcaatacaacattcaagttgaagtcattgacatgatggcctacggaatggcagatgggaaaaaagcgtatgagcaggcattgtccttaatggtgaatcaataatggaacagatgaaaatcacgaatttaacagacgagcaaatcagttttcagctaatcctgcacagcggaaatgcccgaagctgcatcatacaatcactgcgcgcctataaagaagggaacaaggacgaggctgatgccctcattgccaaggcggagcaggatttatccgcggcccatgacattcactttcaaatgatacagaaggaatccggcggagaagcaacagctttttcattgctgcttatgcatgcagaggatcatctgatgtcaacattatccatgaaagaattagtgaaagagatgcttgatctctttaaaaccaagaatatataaaaaataggggtggatagggtgttcgagaaaatcagccaattccttgttccaattgcagggaggttaaacaataaccgctatttgcaagtgttgcgtgatgcatttatgctggctttcccgctgacgatattcgggtccatttttgtcgtgttaacgaatttgccgtttctaaacaaaatcatgaacgcctcaatgcttacgtcgtttcagtctcatttcggcattgcctccacggcgacaatgggcattatgtctgtctttgttgtgttcgggataggctattacctgtcgaaaagctatcaggtcgaagctgtatttggcggagcgatcgctttggtttcctttttgctcttaacgccatttatcattcagccggaaacaggtgatgccattacaggggttatcccggtcgatcgtctcggtgcaaaagggatgtttcttgggatgattacggcatttctttctggcgaaatttacagaagaatcgttcaaaaaaacctgacaatcaaaatgccagccggcgttccgcctgctgtagcaaaatcatttgccgcacttattccggcttttatcacattgaccgtatttttgctgattaacgtaatggtgactctgttttttaaaacaaatatgcacgacgtcatttatcacgcgattcaggctccgcttgtcggacttggaagcggtatcatcccaacgctgattgccgtgtttttcattcaaattctttggtttttcggactgcatggacagatcattatcaactccgtgatggacccgatttggaatacactgcaggtagaaaacctttctgcttacacggcgggaaaagaaatccctcatattatttcaaaaccgtttatggagatttatacagtagggatgggcggaaccgggatgacgcttgcggttgtgtttaccattctcatattcatgaaaagcaggcagatgaagcaagtatcaaaacttggcctcgctcccggtatttttaacgtaaacgaaccgattatcttcgggcttccgattgtcatgaatccgatcattattgtgccttgggtgctggcaccgatggttgttacgctcgtcacctatctggctatgtcagccgggctcgttccgcctccgactggtgtgacggtgccgtggacggttccattattcattaatggcatcatggcgacgaactcaatcatggggggcgtgatgcaacttatcaatctgctgattgtcttcgtgatctggtttccattcctaaaagcaatggataaattaaatctggcaaaagaaaaagaacaggctgtgcaggaaacagctgctcagcaaaatgataacagcataaaaatgtgacataaggggagagagacttggcacaaacagaacaatatcgttttccaaaggatttttggtggggatcatcggcttcagcaacacaaacggagggtgccgccgacagagacggaaaaggccagaatatatgggattattggtttgaaaaagaaccgcatcgtttttttgatcatgtcggacccgcagacacatcccaattttacgacaactataaagaagatatcaggctgatgaaggaacttggccacaactcgttccggatgtcgatttcctggtcgcgtttaataccaaacggaacgggcgagatcaacgataaagccgcaaatttctataacaatgtcattgatgagttgatcgctaacggaattgaaccttttgtcaatttgtttcatttcgatatgccgatggcgcttcaaaaaatcggcggctgggtcaacagagagacggttgacgcgtatgaaaactatgcaagaacttgcttccgtttgtttggcggcagagtgaaaaaatggttcacgcataatgaaccaatcgttcctgtagaaggcggatacctatatgattttcattatccaaacaaggtcgattttaaagaggccgtccaggttggatttcatacgatgctgtcaagtgcccgtgccattcaggcttacagggagatgaagcaggacggaaaaatcggcatcatcttaaatttgaccccttcatacccgagaagcagccatccggcggatgtgaaagccggggaaatcgcagacgcgttttttaacagatcttttttagatccatctgtcaaaggcgaatttcccaaagagctggttgacattttgaagcatgaaggctttatgcctgattacattcctgaagatcttgacatcatcaaaaagaacacggttgacctgttgggagtgaattattaccagccgagacgtgtgaaagcgaaagaacatcttccgaatcccgacgctccttttttgcctgacaggtattttgatccctacgtcatgccgggccgcaaaatgaatccgcatcgcggctgggagatctatgaaaaaggcgtttatgatattttgatcaatttaaaagaaaactacggaaacatcgagtgttttatctctgaaaacggcatgggggttgaaggtgaagagcgcttcagagatgaacaaggcatcattcatgatgattaccggattgaatttataaaagagcacctcaaatggattcaccgcgccatacaggaaggctcgaacgtaaaaggctatcacttatggacgttcatggacaactggtcttggacaaatgcctataaaaaccgctatgggtttgtatcagtcaatcttgagaaagacggagaaagaaccgtcaaaaagagcggaaaatggttcaaaacagttgctgagcatagcggtttctagattttcctaaaggtcaagatcttccggcaatcatcataacgaatagagatgacgaaaatccgcaacattgatgaaatagggaaaagaacttatgatatccgtaaaagcttatgtgatatcagactctaacagctgccggaggatgccaatgaataaatacgaaattattgcaaatgaaatgagaaatagaattaaaaataacgtatatccgatcgatcagcccattcctgatgaagtatctcttgcaaaagaatttaactcaagccgcatgacgatgaagagagccttggataatttagttgctgagggtctgctgttcagaaaacgaggccatggcacgtttattattcaatctgcaatacaggatgaccatgtacatgtagtcagcaatgagattctcggattgaccaacttgctgaaagataaaaaaatccaaagcaaggtcattcagtttgaagtgcaatttcccactgaggaagtggccgcccatttgtctattgatcaaaaaacaccggtttattatgtcgttcggcttcgaattgtagaaggtgaaccctatgtattagaaaaaacatatatgccgactcatttaataccgggcattaatgacgatgtacttcatgattcgatctacaatcatattacaaatgtgctgcagctcaaaatcgccggaacgcatcggaaaatcagagcctgcaaatctgatcatattgaccagcagcatctgggctgtaaacaggatgatccaattctggaagtggaacatgtgggcttcttagataccgggattccatttgaatattccttttcacgtcatcggcatgacaagtttgttgtgacttctgtaaacatacggcgctgattgcggagacaacaaggaggccatctgcatgcttggcggtattgaagcaggcggcacaaagtttgtttgtgctgtcggtagagaagatggaacgatcattgacaggatagaattctccacaaagatgccggatgaaacgatagagaaagtgattcaatattttcgccaattttcattacaggcaatcggcatcggctcctttggtcccgttgataacgataaaaccagtcaaacatacggtactattacggccacgccgaaagcgggctggagacactatccctttttgcaaaccgttaagaacgaaatgaagatcccagtcggatttagtacagatgtcaacgctgcggcgctgggtgaattccttttcggtgaagcgaagggtcttgacagctgcctgtatataacgattggcactggcatcggagcgggggctattgtagaggggaggctccttcaggggctgtcacacccagagatgggccatatttatatccggaggcacccggatgacgtataccaagggaagtgcccttatcatggagattgctttgaaggcttagcttcaggccccgctatcgaagcccgctggggaaaaaaagccgcggatttatcagatatagcccaagtctgggaactggaagggtactatattgcccaagcgctggctcagtatattttgatccttgcacctaaaaaaatcattcttggcggcggcgtcatgcaacagaaacaagtgttttcttatatctatcaatatgtaccaaaaatcatgaacagttacttggatttttctgaattatcagatgatataagtgattatattgtacctccacgtttaggcagtaacgccggaatcatcggcacgctagttttagcgcatcaggccttacaagcagaggtagcatccggggaggtgcgatcatgacgcatcctttatttttagagcctgtctttaaagaaagactatggggagggacgaagcttcgtgacgcttttggctacgcaataccctcacaaaaaacaggtgagtgctgggccgtttctgcacatgcccatggcccgtcggctgtaaaaaatggcccgctggcaggaaaaacactagatcaagtatggcaagatcatccagagatattcgggtttccggatggtaaggtgtttccgctgctggtaaagctgctggacgccaatatggatctctccgtgcaagtccatcctgatgatgattatgcaaaactgcacgaaaatggcgaccttggtaaaacggagtgttggtatatcattgattgcaaagatgacgccgaactaattttgggacatcatgcaagcacaaaggaagagttcaaacaacgaatagaaagcggtgattggaacgggctgctgaggcgaatcaaaatcaagcccggagatttcttttatgtgccaagcggtacactccatgctttatgtgagggaacccttgtccttgaaatccagcaaaattctgatacaacgtatcgcgtatacgattatgaccgctgtaatgaccagggccaaaaaagaactcttcatatagaaaaagccatggaagtcataacgataccgcatatcgataaagtgcatacaccggaagtaaaagaagttggtaacgctgagatcattgtttatgtgcaatcagattatttctcagtgtacaaatggaagattagcggccgagctgcttttccttcatatcaaacctatttgctggggagtgttctgagcggatcaggacgaatcataaataatggtattcagtatgaatgcaatgcaggctcacactttgtcttgcctgcgcattttggcgagttttcaatagaaggaacatgtgaattcatggtatctcatccttaatgaatgggggagttgcatttgtttaagaaacatacgatctctttgctcattatatttttacttgcgtctgctgttttagcaaaaccaattgaagcgcatactgtgtcgcctgtgaatcctaatgcccagcagacaacaaaaacagtgatgaactggcttgcgcacctgccgaaccgaacggaaaacagagtcctttccggagcgttcggaggttacagtcatgacacattttctatggctgaggctgatagaatccgaagcgccaccgggcaatcgcctgctatttatggctgcgattatgccagaggatggcttgaaacagcaaatattgaagattcaatagatgtaagctgcaacagcgatttaatgtcgtattggaaaaatggtggaatccctcaaatcagcttgcacctggcgaatcctgcttttcagtcagggcattttaaaacaccgattacaaacgatcagtataaaaaaatactagattcttcaacagcagaagggaagcggctgaatgccatgctcagcaaaattgctgacggacttcaagagctggagaaccaaggtgtgcctgttttgttcaggccgctgcatgaaatgaacggtgaatggttttggtggggacttacatcatataaccaaaaggataatgaaagaatctctctatataaacagctctacaagaaaatctatcattatatgaccgacacaagaggacttgatcatttgctttgggtttactctcccgacgccaaccgagattttaaaactgatttttacccgggcgcgtcttacgtggatattgtcggattagatgcgtattttcaagatgcctactcgatcaatggatatgatcagctaacagcgcttaataaaccatttgcttttacagaagtcggcccgcaaacagcaaacggcagcttcgattacagcctatttatcaatgcaataaaacaaagatatcctaaaaccatttactttctggcatggaatgatgaatggagcccagctgtaaacaagggggcttcagctttatatcatgacagctggacactcaataagggagaaatatggaatggcgattctttaacgccaatcgttgagtgaatccgtaatgtcacaattaagaaggtgctcaagaagtttcttgagcaccttcccactggattaagcattcatatcgcctaacccaggactgtgttcatttggtatttcaggaagcactggtacgggaaaccctgccggaggatctattacttgtaactctccgccatttcggcttggagatttcccttgatagatttcactgattctcgtttcatccaacctaaagttaaactgtgcattatgatagcctaattcgacatactttctgcactcaggatatttattaatgtcataattcggtacagggagcagcttcgcccattcaacgcccaatgtctcgagcgctttcgcgaatgcattctggtgagcattgtcgcgtacaatcagaaaagcaagtgtttcgcggaacgtctgattagagctcatttcataaattcttgttttttgcagcacacctgtcgactcaagaagcaggttatccagcaggtcagtaattaagtttccgtggttatacacccacgacccgttccacggattgccccctgcatcaacaggaagggaactttgcgctccaataatataatgatgaggattagcatgtttaaccgcttcatcaagtggcgcttgatctgcaccttgactgccgacaccttcaccgcctgattcatctaataaagcattgattgtgttttgaaccagttcaacgtgggcaatctcctctaaaaaaatgccgcgaagcagatcgcggtactgtttctgctttcctctgaaattagagctttggaaaaaaaactgcatcattgtacgcatttctccgtaatgaccgcctaatatctcctgcaggaccttagcagctgccgggtctggcttgtccggtttaatgatattaatcagttcctctttgtagtaatacataacacgcctcatttcttcttaagagattttcttatattatttgtaagatgagataaaatatatacatgataagcatgggaagacgtgaaagaagaaaataaaaaaatacatgaaaagtgttgaccaaatgaaacaagcatggtatattattaaacgtcgctgatgaacagcgtgaaacaaaacgaaaaacaaaaaagtttttctaaggtgtttacaagattttaaaaatgtgtataataagaaaagtcgaattgaaaaagattcgaaaaaacattttaaaaaaacttcttgacttcaccatcaaatgatagtatgatagttaagtcgcttgataagcgcccgtagctcaattggatagagcgtttgactacggatcaaaaggttaggggttcgactcctctcgggcgcgccatttaagataccacgcgggtgtagtttagtggtaaaacctcagccttccaagctgatgtcgtgagttcgattctcatcacccgctccattattgaatgatctttgaaaactaaacaagacaaaacgtacctgttaattcagtttttaaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaatacaagatatcacaagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctatacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgttacatctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcattacttttatcatcgcggggtggagcagttcggtagctcgtcgggctcataacccgaaggtcgcaggttcaaatcctgcccccgcaaccaaatatatgattaaataaggagtgccctaagggtacaactaaaataatcttatacaaatatggtccggtagttcagttggttagaatgcctgcctgtcacgcaggaggtcgcgggttcgagtcccgtccggaccgccattaatgtaaacgaaacgatcatgttttcgttttttttgtgttttcttttactgtatcttctgcttggtgtcatagccaagctttctttatatcgggaacatcttggatattccagcaaaattcgataaactaggaagagcacatataggcataagcagggttgaaaggagattttggttcatggatgaatttgatttgatacatagcattactccgcggaccattcaccattcttccgttgatgtaggaataggtgatgatgcagcgctctacactgcgaaacacggcgttcaggaaattgtttgtgttgatactatggtagaagacgtgcacttcaaattacactattcctcacctgaagatatcgggtataaggcgttagccgttaatataagtgatattgccgcgatgggaggcattccgaaattttatttggtatcacttgcggtaccttcaaaatggacggcatccgaaatcaaggcgatgtatgaaggaatgaatgaactggcgaaactatatcagatggatctgattggcggcgatacagtttctaccgctgacaaattagtcgttacagtcactgtgatcggtgaaattgaaaagggacaggcctgtttgcgcagcttggcaaaaccggatgatattgtgtttgtaaccggtgaaatcggttcttctgcagcagggctttctttattgctggaagagactaatcctcaaaactcatctgtggaaacggattactttatccataggcataaacggcctgagccaagagtaagcgtcggcagattatgctcgtgttttaaacgggcagctttaaatgatgttagtgacggattggctagtgaactgaacgagattgcagaagccagctgtgtttcaattgaaattgatgaaagcatgcttccaattcattctgatttacctaagcttcatcctaactggaaagaatgggctttgtttggcggtgaggattttgagctgacagggacggtttcaaaagaggagtgggaagtgttgaagcagcagtgcgcagcacgtcaacttcccattacaaagattggccatgtcagggaaaaaacaaaatctaaagtgatcctaaaaacagatcaaacatcaatgatcttagagaaaaagggatataatcattttaaataagacgggtgactcgtgtgaagcaattaaaatggagaactgtaaatccagaagaaacaaaagcaattgccaagcttgcggcagcgtttgctaaaccgggagacgtcctgacattagagggcgatttaggtgcaggaaaaacgacttttacgaaaggttttgcagaagggctgggaattacacgtgttgtaaacagtccgacttttacaattataaaagaatataacgatggcgtacttcctctttatcacatggatgtgtatagaatggaagatgaaagtgaagatttgggacttgatgaatattttcacggacaaggtgtctgtctcgttgaatgggctcatttaattgaagaacagctgccgcaggagcgactgcaaattgtcatcaaaagagctggtgatgatgagcgggaaattacctttactgctgtcgggaatcggtatgaaatgctttgtgaggagttaagtagacatgacaatattagcaattgatacatcaaattatacattgggcattgcgctgcttcgagaagacactgttatagcagagtacattacatatttgaaaaagaaccactctgtaagagcgatgcctgctgttcattcattgctgaatgattgtgatatggcaccgcaggacctttctaaaattgttgttgcaaaaggccctggttcttacacaggagtaagaataggtgtgacgttggccaaaacacttgcctggtctttagacattccaataagtgctgtatcaagtcttgagacgcttgcggcaaatggtcggcattttgacggtctgatcagcccaatctttgatgctagacggggacaggtgtacacaggtctgtatcaatataaaaatgggcttttagagcaagttgttccagatcaaaatgtgatgctggcagattggctggagatgctaaaagaaaaggaccgccctgttttgtttttaggccatgatacttctcttcacaagcagatgatcgaggatgtgcttggaacaaaagggttcattggaactgccgcccagcataacccgcgtccttcagaattggcttttctcgggaaggaaaaggaagcagctgatgttcatgggcttgtcccggattacttgcggctggcagaagctgaagcgaaatggattgaaagtcaaaagtagggtgataggatgaaaacaaaagcagcggtcagaaatatgcggcttgaagatatagatcaagtatacgaaatcgaagcatcctcctttacgtctccttggacgaaggattcgttttatcatgagctgctggaaaatccatatgctcattatctcgtgattgaaaaggacggccatcttgctgggtattgcgggatttggattgtgatggacgatgcccaaattacaaatatagcgataaaaccagagtatcgcggccagtctttaggagaaacgctttttcgctcagctgttgaactgtgcaaagaaaaagacgcaaggcggctttcgcttgaagtgagggtttcgaatcatcctgctcaaggcttatataagaaattcgggatgcagcccggcggaataagaaagaactattatactgataacggggaagatgcgttaattatgtgggtgacgataaatgagtgagcaaaaagacatgtacgtattaggaattgaaacaagctgtgatgagactgctgcagctattgtgaaaaacgggaaagagatcatttcaaacgtagtagcctctcaaattgaaagccataagcgcttcggaggcgttgttccggaaattgcttcaagacatcatgttgaacaaatcactttggttatagaagaggcgtttcgcaaagctggcatgacgtatagtgatattgatgcgattgcagtaacagaaggtccgggactggtgggagcgcttcttatcggagtgaatgccgctaaagcattgagctttgcacataacattccgttagtaggcgttcatcatatagccggtcatatatacgcgaaccgtcttgtagaagacatcgtgttcccggcactggcattggtcgtttcaggaggccatacagaactggtttatatgaaggaacatggatcatttgaagtcattggggaaacccttgatgatgcggcaggagaagcctacgacaaagtggcgcggacgatgggattgccatatccgggtggaccgcaaattgacaagctagctgaaaaagggaatgacaatattccgcttcctcgcgcatggcttgaagaaggctcttacaacttcagctttagcggattgaagtctgcggtgatcaatacgcttcataatgcatcccaaaaagggcaagagattgctccggaagatttgtctgccagtttccaaaatagtgtgatcgatgtcttggtaaccaaaacggcgcgcgcggcaaaggaatatgatgtcaaacaggtacttttagccggaggagtagctgcaaacagaggcctcagagctgcattagaaaaggaatttgcccagcatgaagggattacgcttgtcattcctccattagctttatgcacggataatgctgcgatgattgctgctgctggtacaattgcttttgaaaaaggaattcgcggtgcatatgatatgaatggccagcccggccttgaattgacttcttatcaaagtctcacgagataatagcgtgagactttttatctgtttgttattaacagataattcacaatttatccacatgtctgtgagtaattatagagatatagatggataaagggctgaagtcactgttaataaagtggataaattcagaatattttgtggatattgtgtataaagcgcttactttgttttgcttattagggtatgttctgtggataaaaagcacctctaaaaagaggtgcttgacttttttaatcttcttctgtggatagttcttcccattcggacaaaagagattccagctcctgattaagcttctcattgtctgcatggatagcttgtactttttcatgatcctgatagacttcagggtcacatagcaattcatcattgcggctgatgttctcttcaatggtttgaacagtggtttcaatttcttcaatccgacggagtcgttggcgctctttctttttccattctttttcttcctcgtaggaacgtttggagtcagacttcacagtagctggcgttttttcagtttcttcttgctgatttattttctccaattcaaactgctctgtttttttctcagtataataatcgtaatctcccagatactcctctatatggcttgaagaaagctccaatactcttgtggcgattctgttaataaaatatctgtcatgtgagacaaataacagtgtgcctggataatcaatcagcgcgttttcgagaacttctttgctgtctaaatccagatggttcgtcggttcatcaaggatgagaaagttggctttttgaagcatcagcttagctagagccaatcttgctttttcgcctccgctcagtgaatgaactggtttcagcacatcatctccggagaataagaaatttccgagacacgttctgatttctttttctgggagcccggggtactcgtcccacagctcatcaaggacacgtttagaggaagtcagctcagcctgttcctgatcataatagccgacactgacatttgagccgtatgagatcgttccttgatctggttttagggtgtctatcaatgttttcagtaatgtcgatttaccaattccgttagggccgacaagcgctgcgctttctcctcttgtgagcatgaatgacacttctgttaaaagcggcggctggttttcatagctgattgtgagatcctgaacacgaaggacttcatttccgctctgttttgtaatatcaaaatgaaagtttgcggatttttcatcgccaagcggttttgacatgacttccattcgctcaagctgctttctgcggctttgcgcccttttggtggtagaggctctcgccaggtttcggtctacgaagtcctgcagctttgtaatctcgccctgctgcttttcatacattttaagatctttttcatactgcgcggctttttggtcgagataagcgctgtagttgccgtgatactttttgctttctgctcttgatacctcgtatacctggtttactactttgtccaaaaagtagcggtcatgcgaaacgatgagaatggcgcctgaatagccttgcaaataatgctcaagccaggtaagcgtatcaatatccagatggtttgtcggctcatcgagaatgagcaaatcaggctgtgttaacagaagcttacctaaagccagtcttgttttctggcctccgctgaggctttgaacctgtgtagaatcgtcaaaatggctgaagccgagaccatgcagcacagatctaacatccgcttcatattgatagccgcctttatctttgaattcctgctgaaggcggtcgtaggttttcatgatgctttctaattcaccggggtcagctgccgccattttttcttccatagcccgcatttccttttccattgcttttaagtggtcaaaaacagtcagcagctcttcttttatggtaagcttagaatccaagccagtatgctgagcgagatatcccattgtaatatctttcggtttaataatttcgcccttttcatacgaaagctggcctgcgataattttaaggagcgtagattttccggcgccatttcttccaacaatggcgatgcgatcacgatttctgacttccagctttatattgtttaaaatagtatcagcaccaaacgatttggacagctgattaacttgtaagatcatcatattatttcacctctgctataataagttaagtgtagcttatgaaccagaagtcagcaaacaatacattggccatataagacatagagaagaaaatagtgtatgatctgtttaaggagcgttttaatatgaatggattttctcattttaatgaacagggcagagcccagatggtggatatcagcgaaaaatcttcgactgtccgtactgcggcggctgtttcaagcgtacacatgaagaatgaagtgtacgagaaaatacagagtcacgatatcggcaaaggagatgtactggctgtcgcacaggtggcaggcattatggccgcaaagcaaacgtcgaatatcattccgatgtgccatccgctttcattgagcgggatagatatatcgtttgactggaaaataaaagaagcagaagttatacttcatataaaagcacaggtcaaaacaaaagggagtacaggtgtggaaatggaagcgctcacttctgcatcggtgtgcgctcttaccgtttacgatatgtgcaaggctcttgataaggggatggtcatcggccctactttcttgctggagaagacaggcgggaaaaacggtgactttaaaagagaactatccgagtataatttggaggaccaaaaatgaataaggatcaatcaaaaattccgcaggcgacggcgaaacggctgccgctttactatcgctttttaaagaatctgcatgcgtcaggaaaacagcgtgtatcatccgctgaactcagtgatgccgtaaaggttgattctgccacgattcggagggatttttcctattttggagctcttggcaaaaaaggatacggatataatgtggattatttgctgtcttttttccgaaaaacgcttgatcaggatgagatgacagacgtcatcttgattggtgtcgggaacttgggaacggcatttcttcactataatttcacaaaaaataataacacaaaaatttctatggcttttgatataaatgagagtaaaataggaactgaggtaggcggcgtgcccgtctataaccttgatgaccttgaacaacacgtaaaagatgaatcagttgccattcttacagtgccagcagttgccgctcaatccattacagacagattggtcgcattaggaatcaagggaatccttaattttacgccggcccgtttgaatgtgccggaacacattcgaattcatcatatagatttagcagttgagcttcagtcactggtttattttttgaagcattattcagttttagaggaaatcgaatagagggaaaggaggagcccaaatatgccgatcggtcctggaagccttgctgttatcgcaatcgttgctctgattatcttcggtcccaaaaagctgcctgaattggggaaagcagcgggagacacacttcgtgaattcaaaaacgctactaaaggattaacgagtgatgaagaggaaaaaaagaaagaagatcagtaagttaggatgacacgaatgaaagtgaatcaaatgtcgctgctggagcatattgctgagcttcgaaaacggttgctgattgtagcgctggcgtttgtcgttttctttatagctggattttttttagcgaagccgattattgtgtatctgcaagaaacagatgaagcgaagcagcttacgcttaacgcgtttaacctgacagacccgctttatgtgtttatgcagtttgcgtttatcatcggcatagtcctgacctcgccggttattctttatcagctttgggcttttgtgagcccgggtctctatgagaaagagcgcaaagtaacgctcagctacattccgatctctattttgctgtttttagcgggcttatctttttcatattatattttatttccttttgttgttgattttatgaagcggatctctcaggacttgaatgtcaatcaggtgatcggaattaatgaatattttcattttcttctgcagctgacgattccgtttggactgctgttccaaatgccggtcatcctcatgtttttgaccaggctcggaattgtgacaccgatgttcttggcgaaaatcagaaagtatgcgtattttacgctcctggtgatcgcagccctgattacaccgcctgagcttctgtcccatatgatggtcacagtcccgcttttgattttatatgaaatcagtattctgatatcgaaggccgcctatcggaaagcgcagaaaagcagtgcagccgatcaggacgtgtcttcggggcaataataaaaaatccatttctcatgagagaaatggattttctttatttttggttctttttgattttaaatgaaaaggcgaacatcttaaaagaaatgctgatgttgtaagcggcgaacaccatcagcaggatggagtaaaatgaccacatgctgcctggcgagcttgcggcaagataagtaaagatgcaccctacggcaaagtagatcattccccaaactaccgggtttctcataaaaataatcctccaataatcaattgcatttgtgtgctctgctgttcaaggtaattccgaacaggctcaagctgcatgatgacgacgaatgtattcatcattaaatgggcgaaaatcggcacccatatccgttttgttctcgcatataaaaaggcaaaggtaaagcccattgctgtatatagaagaagatgcttcaaatcagcgtgaacaataccgaagataaccgagctgatcagtcctgcaaaaaagaaattcgttttttcgtacagcgcgccgaaaatgatttttctgaagatgatttcttctaatataggcccgacgatggaagaaacgataatcatgagcgggactgcctgaatgacatccagaatcgcttgtgtattttctgattctcttccgatgccaaaaacataatattcaatagagcctgctattccttgagagaaaagggcaatgaaaaaaccggctatcgcccaaaggatagaaagtccgattgagtccttctgtccgtttcgcagcgtttctttcggaacggttctcagaatgagcagaacaacaacgagacaggcgataaagctgataacggaccataatccttgtgcatgcagcatattttcatctgtaggctgtcctccggcataaccgaatttaaataacaagggaatcgcgattaatgcggaaaactgcatgatgatatatgtcaaaataataaaccaatactgttttctcaaatggtatgtactcctttgttaagtgggtttcgttcatctacagctattgtaacataatcggtacgggggtgaaaaagctaacggaaaagcgagcggaaaagaatgatgtaagcgtgaaaaaatttttatcttatcacttgaaattggaagggagattctttattataagaattgtgttagcactctttagtgctgagtgctaaaattacatattcatactattgaggaggttattacattgttaaagccattaggtgatcgcgttgtcattgaactcgtagaatctgaagaaaaaactgccagcggaattgtgttgccggattctgcaaaagaaaaaccgcaagaaggcaaaatcgtggcagctggttcaggtcgcgtgttagaaagcggagagcgcgttgctttagaagtaaaagagggcgaccgcattatcttctcaaaatacgcaggtactgaagtgaaatacgaaggtactgaatacttaatcttacgtgaaagcgacattttagctgttattggctaattcttaaataaacaatatttaaaacatttgaggaggtcttgtaaacatggcaaaagaaattaagtttagtgaagaagctcgccgcgcaatgcttcgcggtgtcgatgcacttgctgatgctgttaaagtaactttaggaccaaaaggacgcaacgtggttctagagaaaaaattcggttctccgttaatcacaaatgacggtgtaacaatcgctaaagaaatcgagctagaagacgcgtttgaaaacatgggtgctaagcttgttgctgaagtagccagcaaaacaaacgacgttgccggtgacggtacaacaactgcaacagttcttgcgcaagcaatgatccgtgaaggccttaaaaacgtaacagcaggcgctaaccctgtaggcgtgcgtaaagggatggaacaagctgtagcggttgcgatcgaaaacttaaaagaaatttctaagccaatcgaaggcaaagagtctatcgctcaggttgctgcgatctctgctgctgatgaggaagtcggaagccttatcgctgaagcaatggagcgcgtaggaaacgacggcgttatcacaatcgaagagtctaaaggcttcacaactgagcttgaagttgttgaaggtatgcaattcgaccgcggatatgcgtctccttacatggtaactgactctgataagatggaagcggttcttgacaatccttacatcttaatcacagacaaaaaaatcacaaacattcaagaaatccttcctgtgcttgagcaggttgttcagcaaggcaaaccattgcttctgatcgctgaggatgttgaaggcgaagcacttgcaacacttgttgtgaacaaacttcgcggcacattcaacgcagttgctgttaaagctcctggcttcggtgaccgccgtaaagcaatgcttgaagacatcgctgtccttactggcggagaagtcatcacagaagatcttggccttgacctgaaatctactcaaatcgctcaattgggacgcgcttctaaagttgtcgttactaaagaaaacacaacaatcgttgaaggcgctggcgaaacagacaaaatttctgcccgcgtgactcaaatccgcgctcaagtggaagaaacaacttctgaattcgacagagaaaaattacaagagcgtcttgctaaacttgctggcggcgtagctgtcatcaaagtcggcgctgcgactgaaactgagctgaaagagcgtaaacttcgcatcgaagacgccctgaactcaactcgcgcagctgttgaagaaggcatcgtatccggtggtggtacagcgcttgtaaacgtatataataaagtcgctgcagttgaagctgaaggcgatgctcaaacaggtatcaacatcgtgcttcgcgcgcttgaagagccaatccgtcaaatcgcacacaatgctggtcttgaaggatctgtcatcgttgaacgcctcaaaaacgaagaaatcggcgtaggcttcaacgctgcaactggcgaatgggtaaacatgatcgaaaaaggtatcgttgacccaacgaaagttacacgctcagctcttcaaaacgctgcgtctgtagctgcaatgttcttaacaactgaagccgttgtcgctgacaagccagaagaaaacgctggcggcggaatgcctgatatgggcggcatgggcggtatgggtggtatgatgtaataccgacaaaaaacccttgatttacaaggggttgtcggcaacggacgtcatttttgatgccctttataacttttcgaggcttctcatgagttcactgaacttgtgagaagcttctttttttctgtctttcgtagtttgattttttcagcactgttctatatcgattttcaatagttttgataatcccgatatgaactattcaattgaccaaaatacaaaattctaccggctcagattcctgtttacgtcttctttgataaacggcttactgtaacttcagtaaactgcatttctgttatgattataaaaagggtttaaaaatttttcgtccaaacctctgttacttctctccctattgcagacaggagatggtatcctctcatacagacaaaaaagccccagttttctaaataaatagtgtcaccaacactcttagaagtttccctaaggagtacattgccaaagagaaatcctattaaaatgtctatttgtgctgctttttagctactaagacgatgtatgttaaagatatagaacggcagaataatctgattctcaaaaattcactgtcggtgtagttaggttcttccaccaacatcttgataatattcatcccgactctatggagaccgacattccaattattaaatctaatattagttttttatgattaccaaggaggacttaatagtgcatttttcagaaatgatagatcgcttggctttatatgatttacacagaaaaagaagcaaagataaacatttttctgctgctattgcagccgatatcgatgatagagaggaattttacagtgcgaatatagctgatgtttcaattgatttgaatgaatctaaaaaaaagtatagggttggaacatttcgttatgaatccttaattcaaactgggaatcctgttaatgatactttaaaaggggaggtttttttacataaaaatgatatagatcaacccaatgttatctttgtacacggctggcgcatggaatcgtacaataggatcaaaagaatatttcataagcgtataatgaatgatttaggctggaacatgtattattattctcttccataccattttgaaagagaaccggaaaattcactgtatagtggcgagttgatgattagtgcgaatattgatcgtacaattgagtcgacaagacaggccattgtagatttacgggcattaattcactggataaaagcaaataaaaaaggccctgttatcatagtgggggtaagtttagggggatggatcactaatctaattgctaccctagaatctcaaattgatgtagtggtatcaatcttttatgccaatcgcctttcttattcaatatggaacacgatcccaggtaaattcataagagaagaattagaacaaaatggtgtgacctatgaagatttaacaaaatattggaatatcacagatcctagtcaagccttgccgaaagttaataaagataacattctgctgatttctgctaaacatgatcagtatattgacttaaaagatgcagattatttatgggaaagttgggagaaaccgaaaagatatgtctataattgcggtcattccggcattgttctttgtcgcaaaaagctggcaaatgatacgatttcctttataagagaaaggataaatacgggaaaacctggttcagtacatttgtagaccttaataagaaacaaaaggccaactgcaacttcagttggccttttctatttataataaagaaactgggtgagattgctgtcagaactactatgcgtactagtcgttttctttaatcaccattgccagttcttccacctcaccccgaatcccaatcgcaggctcccacgaatcaatcaaacgaatcgctctctgattagcttccatcgctttcgttttctctcctttacggttcaacagctgcgccatcccgtaaaaataatagatcaactcaacctgattggcgttatgtttgtcatagagcatttgctcaaaggcttcttccgctttctcaaattgaccacatttcacgtaagcgacacccagattgaaataggcttctatcgttttttcgccgccgtacgtggagctgatttcatttgccgcttcgtataattgaatggcttcttcatgatgacctctcgcaaagcttaagtcaccgcgaaccaaaagaactctgtgttgaatggtaggagaaattggttgatcttcgatttcgtttaaaatggtctctgctttttcctgttgcccgtcttttaaaaacagccttgctttgagtgcatgtccccaaacctttagatcataggcatcgtgagcatctgattgttcaagaatcttcagcccggcttctatttgctgtaaggccctgtctaaatcattgacttccatcagagcccagcctgctgtgtcgattcggaagtacgcttctcgtgtgtgttggcctaagtgatgggcggcgtcggccgctttgcgtccgtattcgattcgcaggggcaggttgattctgcttagaaaatggctaatgcgggtgatgagttcgattaggatttctttttgttcagtttcacttgcccattggatgacctttaagatgtttggccattcttttttcatttgatctaagttccgtcccagcaggtagctccaatagatagagttgggctgttcccgctttaaatgggtttcggcataatcaacataatagtgcgcccagcgattgcgggcttctttttcatattcgtgctgttcggacaagtgctgttctccgtaagcgacaacggtttggtgcgctaagtattgtgtccttccttcgcttcgttccggctgaatcagagcgtatgaccgcatttgttccatagcgtaatgaaaacggcgggcgtctaatccggctgctgccgccaggcttttttcatcaggcggcttgctgaaaaagcaaagcgtctgccagagctttcgtgtatcttcattgcatctgtcccaggtgcggccaaagaggaattcaaacaattccagcagtgagtagcctgcttttccaagctcatgaatcaactgctgcgcggggatgtcatcgtctgacatataggcgatgctgagtgccatggctttcgggtttccagcagtcgctgaaatgaattcgtttttcagatcagatgatagatgtaacagctgctccagcttttcccgcttatgtgggaggttgcatgtttgtaagcagcggtgcacttcttgctggaaaaatttcaaggcatctgtttggttaaggccgctcagctgaatagctgtcatttctccgaagctttcccgataagtttgctttacgttttcccgcgctgtgaggagaactttcacgccttgcggaaggctggtgataaattcatgaatgtcacgttctgcagtatcaatgctgtcaacgatcagcaggatcggtttttctctagtgtaattagctaacgcattgcggacgacgaatcgtttttcattgattgatttatcgatttgttctgtacgtccgagctgataggcgatcgtatttaaaaaatcgctaaagctcaatcctttccaatcagcgctgacccaaatgatactgttgaacgccggccaatctgaagtatcgtcgacacaggaataggctgcttcaagagcgattgtggttttacccataccagcccagccggtgattaaacagactggtgacggagaaagcatccattgccgtatcgcttccatatcaaagctgcgtccgataaagcgtccggaccagcgtgagggtaaattatgagtgataggctgttctgtaagcgcattcgtttcatggccgggtctgtcatgaaacagccgttttactacattttcaatttcgtcttcactcggagccccgaataatccgtcttttcgcagtattttcgcttttttcaaacaggatgctgcccatacaggcaatgcgggtttgatgactgggatagtggtggcttccagcaagtcggtcaaccactcgatatccaagtcggtcttttcgagaatgatccagatcattccgaacagttttccgtcgtcgattcttccgggaatgtagtttgctcccatctgtccgatccagcttttgatcgtgtttggggagactcccagctggagtgcgattttatctatgtaagactgtcctgttttttcattctttttccttctgattttataatcaggatgaagttttagcgttttgacgccaggtgccagcagttgtgcaaattgttttcggttttcaagttcagccataagcctgcacctcctattagtactattttatcaatccagcgttttttgtatatgaaaaaataaaagtacagtgccgctgtccttttatacagcaggaaaggctgttgaacgtgttgaaaagcagataaaatgggggcagtaacagagaaaacaaaaatgtatgcacttacattttattttctaaagaaaggaacttgccaaatgactcacacagtacctcaaaacatgaaagcggctgttatgcacaacacaagagagatcaaaattgaaacattgcctgtgcctgatatcaatcatgatgaagtgttgattaaggtgatggctgtcggaatttgcggatctgatctgcattactatacaaatggccgaataggcaactatgttgtggaaaaaccatttatccttgggcatgaatgtgcgggtgaaattgccgctgtcggatcatctgtcgatcaattcaaggtgggagaccgcgtcgctgtagagccgggtgttacgtgcggacgctgtgaagcgtgcaaagaagggcgctataatctttgcccggatgtacagtttttggctacaccgccggtagacggcgcgtttgtccaatatattaaaatgcgtcaggactttgttttctctatcccagactcactttcttatgaagatgctgctttgatcgagccgttttctgtcggcatccatgcggcggccagaacgaagctacagcccggatcaacgattgcgattatggggatgggccctgttgggttaatggctgttgccgcagctaaagcatttggggcaggcacaatcattgtcaccgacttagagccgctgcggttagaagctgcgaaaaaaatgggagcgactcatattattaatatacgtgaacaggatgcacttgaagagattaaaacgatcacgaatgatagaggcgttgatgttgcttgggaaacagcagggaatccagcggcattgcaatccgcactggcttctgtgcgccggggcggaaaattggcgattgtcggtttgccttcacagaacgagattccgctcaacgtgccgtttattgcggataatgagattgatatttacgggatcttccgttatgccaatacgtatccaaagggaatcgaatttctcgcttccggcattgtggacacgaagcatctagtaacggaccaatattctctggagcagacacaagaggcgatggaacgggcgcttcaatttaagaatgaatgtttaaaagtgatggtgtatccaaatcgctgagtgaacagggaggatcttcgtattctccctcttgtttactggaaatgaaaacggattcttggggtgggaaatgatgattgaaacagaaaaagtaacggcaatgaaagtgaagcatcagtcaaaatccagtaccggactgtcctggtttgaacgaatcggttatggattcggtgatatgtcgtataatattatctttcagtttgtaaacgcatacttattattttattatacagacgtcggcggcattcagcctgcggtgatcgcaactttgtttcttgttgtgcgtgtgctggatgctatttttgacccgatcatgggattgattttagataaaacgaatacaaggtggggaaaagcaaggccatatttgctgtgggtggcatttccttttgcgctattcacattcttatgtttcacgacgtctcatttcggtgagaccggaaatatggtatatgcgtatgtcacttatattctgcttgggatgtcctttagtatgcaaacgatcccggtgaacagcttaacggggcggatgacgaattcggtggaggaacgaacggttctgaccacaacccggatgattttggtgtatatcggcattcttttatccatttcctgtgcgacaccgcttgcaactgctatcggaggagaggatcaggcgtttggatttcaaatgacggcgctcatctatgcggctgtcagcatcgttttgaatctatttagtttcttttctgtacgggagcgaattcagcctaaaaagagaaaaaaacaagggatcaaaaagacattatccgttttattccgaaacaaacccttgcttatgttaatttcatcatttttggcttttgcgatcgggtttaatattaaactcagcacgatggtgtattattttacgtataacgtcaaccataaagagttcgtatttatgggcaccgttttatttttcggagcagcgctgatcagcaatttgtttattcctttcttttctgagaagtggggcagaaaacaagtcatgatcatcacggcagctctatcgcttatttcttatgccggcctgcattttacgccgtattcttccattacactcattttcatttggcttttcgtttcgggatttttcacaacgcctttaaatacgcttgcttggggaatggtggctgattgcgtcgattatgcggaatggaaaaccggagttcgcgcggatggtgttgtgatttcgagcatgagctttattaataagctgggtgttgcgttagccgggtcattttcggccatttacttaggaatcgccgggtatgtggcgaatacagaccagacagttgcgtcattgaatgcgattaaaaatatgaatgctttgattccgggatttttcattttgctttctattattcttatcgccttctatcctttaacggaaaaaagatataaacacatcatctctgagctggagcaaaggtctgcgagataaatagatgtaaaatttttaatattcaatgttgtatttatggcagaaagtaatatactgagactgtaatctagactttataaatgagtgtgataatatgcgtagtcattctgtagtttgtattggggaattgttgatcgatttcttttgtaccgatgttgacgttgatttaatggaagggcgccaattcctgaaaagtgccggcggggcaccggcgaatgtgtcggcagcaattgccaagctgggaggagacgccgctttcagcggaaaagtaggaaaggatccgtttgggtattttctgaagcaaacattggacgctgtacacgtcgatacctctatgctggtgatggatgagaaagcgcctacaacgcttgcttttgtttcattaaaacaaaatggagagcgtgactttgtttttaacagaggcgcggacgctttgtttacgctggaggatattgaccatgaaaaactaaacgaagcgaaaatccttcatttcggctctgcaacggcactgctatcagatccgttttgctcagcctatttacggctgatgtcgagtgcggaagacaatggacagtttatttcgtttgaccctaactaccgtgaagatttatggaggggaagagtctcagagtttgtaagtgttgcgaaaaaagcgatcgctgtaagtgattttgtgaaagtcagtgacgaggagcttgagattataagcggtgtgaaggatcatgaaaagggagttgcgatccttcatgagatcggagccaacattgtcgctgtgacacttgggaaaagcggaacgcttctttccaatggaaaagaccgtgaaatcattccaagcattccggtgacatcaattgactcaacaggggcgggagatgcttttgtcggtgcggctttatatcaattggcaaacacggatcagattcaatctgtagatgctaattttgtgaaactgcgtgagattgtgtcgtttgccaataaggtcggagctcttgtgtgcactaaaattggagcgattgatgcactgccgagcttggatgagattgaagtttctttgtaaacattgaagatgtttcttgaaagtctttggacttttggaggcatctttttttattgcttacatttttgttcgggtaaaaagttgtgtattttttgtttgaaatgtcattttttattaaaaaagtgaaacttttaacgataataaatagtatatgtaacaagggttaccgaatttgctttaggaggaacgatataatgagtataattggaagatttaaagatattatgtctgcgaatatcaatgctttattggacaaggctgaaaatccggagaaaatggtagatcaatatttaagaaatatgaatagcgatttggctaaggttaaggcagaaacagcagctgttatggccgaggagcagagagcaaaaagagaatatcacgagtgccaggcggatatggaaaagatggaaagctatgcaatgaaggcgctgcaagccgggaatgagagcgatgcgagaaaatttcttgaaagaaaaacatctttggagtcaaagctttctgagctgcaggcggcgaatcaaattgctgcaaccaatgccgcacagatgagaaagatgcatgacaaattggtatctgacattggagagctggaagcacgtaaaaatatgatcaaggcgaagtgggcagtagcgaaaacgcaagaaagaatgaacaaactgggcgcttctgtttcaagtacaagccaatcaatgtctgcattcggccgaatggaggacaaagtaaataaggcacttgatcaggccaatgcaatggctgaactgaacagcgctccgcaggatgatatggctgatctgactgcaaagtatgacactggcggttcaagccaggttgatgatgaacttgcggcgttaaaagcgaaaatgatgctcgataagtaatacataggaggccgcagctctcggctgcggcgtcattttatcataagatgtgagagggaacggtaatgataatatcttataagtgtccgaactgcggcagtgatatggcatttgacagtgaaaccggctcgttatcctgcagcagctgcggaagacaggacaatattgaaagccttccgaaagaaaacattgcggcacggttttctgatgatgaagcaaaagaatatcaatgtgaaaactgcggtgccgttttgatcacggaagctgaaacgacagcaacgacgtgcagcttctgcgggggtgctgcaatacttgccgatcgattatcaggtcatttggcaccggcgaaagtcatcccatttacaatcagcaagcaagaagccgagcaggcatttcgaaagtggtgcaaaaaaggccttctgacaccaagaggtttcatgtctgccgatcgcattaaaagcatcaccggcatgtatattccgttttggatgtttgatttaaatagtgaagtacaggtgagagcaaactgtaccagggtccaccggtatgaagaaggggattatatttgcacggaaacagagcactttgaagcatttcgtgatatcaatctcgattatttgaaaatccctgtcgatgcctctgaaaaaatgaaagacgaattaatggacaaattggagccttattcatacgaagagctgaaggactttcaaacggcatatttggccggttatattgcggaaaagtacaattataccgatgaggagctttttccgagagcaaaagagaaaatcagcagttatatagattcatacatccattctactttttccggatatacgtcagtcaatgtgagggacaaacatattcacacgaaaaacgtgaacagcttttacgttttgcttcccgtttggatggtcagttacgattatgaaagagcagagcatatctttgcgatgaacgggcaaacaggaaaggttgtcggaaagccgccgatcagtcgaggaaaagtggcggcatggtttagcggaatagcaggcgggacatttcttgcgttgaagctcgtctcattgatgatgggaggcggattttgatgcgtggattttttggaaaagcgatctttgttgtgctggctgttttcatcatgatgcctttactggggatcgaagcggcaagagcttctgaatcacagcagcatgtgtacgatcgcgctcatctattgtcaaaagcggagatcggaaaacttgaatctctctcggcagagctgggtgcaaagagggacactgatttcatcattattacgaccaaaagcacaaacggtgaagatattgcagactataccggcgatttttatgatcgttacggaaaaggcagtacagctattttaacgattgatatggcggatagagaagtattcatctcgggctacgaaaaagctgaaaagtatttggacaacagcaggctcaatagcatcagaaatacgatttcatctgatttatccaatgaaaattattttgaagcttttgagacatatattcagctttcctataaagatatgggcataaaaccgggagtaaaccccgacaacatattctttacatggtggtttcagctgattgctgccatcgcagtcgggggaattgcggtttcaatcatgctttatcatgcaggcggcaaagtaacggttaatggaaatacatatatggatcagcgtacgtctgatgtgattgatcaatacgacacttatattagaacgactgtaacaagagaaagaaaaccatcagataaagacagcggcagcgatggcggtgttacgaaaggcggcacgtcatacagtgggagccgaggcagtttctagtagaagaaaatagagaaagggagaggcgtaatgtcgtttttcagaaatcaattagcgaatgtagtagagtgggaagaatttagagatgatatgattttttataaatggaacaatcgtgaaatcaaaaaagggagccgtttaatcattcgtcccggacaggatgctgtctttttgaacaatgggcgggttgaaggagtctttcaagatgatggcgattatgatattgaatcagaaattattccattcctttcaacgttaaagggctttaagtttggctttaacagcggcatgcgagctgaggtgctgtttgtcaatacgaaggaatttaccgtaagatggggaacaaaacaggcgataaatattccggcagcgggaatgccaggcgggatacccattcgcgcaaacggcacatttaattttaaggtgcaggactatatcagcctgattgataaaatcgctggcgtgaaagatcaatattttgtagaggatattaaaacccgtatcatttctattctggatcagcttctcatgaagtggatcacaagagaagggaaagatatgtttaatcttcaagcaaacgcttttgatattgccaagggaattcaagaggacttggatatgcaattaataagcgacgggatgacggtcactggttttcaaatcatgagctttaattatcctcaagaggttcaagatatgattacaaagaacgcttcctatggtatggttggggatgtgaacagataccagcaaatatcaatgacggatggaatggcatccggaaagatgagcggaggcggagcggcttcggatatggctggaatgatgatgggaatgaatatggccaatcagatgatgaaccaaatgaatcaaaatcagcaggcacagtcatcaggcccacagtcaactggcagcggaagcaaaccgaatttctgtccaaactgcggaacaaaaacgggcgaagccaatttttgtccgaattgcggccagaagcttgtataagaatcatacagtgaaaagtccggagtgatcagacactccggacttttttatttaggagaataagcgttacctattgcttgctcctgaacaggccattttcgagcacccgcttggataattcccagcagcaattgacgacgttcctttattgaattgacggcaatttgaaatgtttgctttgataaagccggtatgcctgattgttgaagctttgagatatctggttccggcggcgcttgttctgcaggatggatataggcagtatgaacggtatccaggtagtttttgatacttgagcgcgcttctttgatgtgaagctgattcggctgatattgttcaggaattccgtatttgaaaatggttagagcctcatccaatacagcaacagctataatggatgattcctgatgctgcgtgctgtggtaaaaatgaaggatggggaaggcgttatgctgagcggtcagctttcccagttctgatgaggcagcgacaagaagaaaatcaatgtcgtgaaaatctttgccattccatgcattatggacgatttctgttccgtcatgtcctagacttaatacactttgggcaaaggagcgtttttgattaaccgcactcaagacggaaatcaaatacgtgacagaaaacgtgatggtaagcagtccttgagctgtttcaataatcgtgacaagcttccataggcctccgttcggagcgaggtcgccatttcctaatgtaaacatgacatagccggaaaaataaattcggtctgaccaggaagccggttcttttgattgagtttccataagtgagtgagggtcactcgagtaaatcaaaacccacccgctccaaaatagactgatccatatcactaacgtcaggcataacagcagaggaccagccatacttagaacctttgcgtggtcaccgctgattttgcggcaacccttccacagccaggcagacaggcatcttgtgatcgggccggcaccgctctctaaccataacgtggtccataaaaaatcaatcatccctgctgtcaataataaaaggcctgcaatgatataaccctcattcattttggttgcctcccttaagtcagccttcttttattttcttctctatttccttttatcctaagtctgaaacaattgaacgaatgtttgattttagatgaagttacccaaaacttactcatttatcgatatgaacagaaaatcacaggatttttgacttgattcacacatttttatgaagaaaaacgttcattttccccttgaattggtgattttccttttatagagtaaaaaattttcagaaatttatattgactgaaagcgtttttataattatgataatatcagatataacaaaaatgtcactattatattactacaattgaactatcaagtgactattaaatgccaaatttacaaggttatgcacaaagaaatgaccattgttcttttagcgagaaatgaaatcgtttccatcaggactgacatgctaagaagaagggaaggttatgaggttattggataaaaacatgaacaactattttctgaagcctgcttacgaaatgtgaggaaggcagcagccctggaataagtttttgacatacgcattttgaaaaagactgggggaaacagtatgaataaacaaggcaatcaaatgtcatttttacgtacaattattttagtctccacttttggcgggcttctttttggctatgataccggtgtgctcaatggagctttgccgtatatgggagagccggatcagcttaatctcaatgccttcacagagggccttgtcaccagttcacttctttttggagccgcgctaggtgctgtgtttggcggcaggatgtctgattttaacggccgccgcaaaaatattttgttcctcgctgttatattttttatttcaacgattgggtgcacgtttgcaccaaatgttacggtcatgattatttcccgttttgtgctcggtattgcggttgggggtgcatccgtaacggtgcctgcctatttagcagagatgtctcctgtggaaagcaggggacgaatggtgacgcagaacgaattgatgattgtatcaggacagcttttggcctttgtttttaatgcgatccttggaacaacaatgggagacaactcccatgtgtggaggtttatgctggtcattgcgtcacttccagccgtgttcctgtttttcggcatgatcagaatgcccgagagtccccgttggcttgtttctaaaggaagaaaagaagatgctttgcgtgtattgaaaaaaatcagggatgaaaaacgggcagcagctgagctgcaagaaattgaattcgctttcaaaaaagaagatcagcttgaaaaagcgacatttaaagatctttcagtcccatgggtgcgccgtattgtgtttattggattagggattgcgattgtacagcaaattacaggtgtaaattcgattatgtattatgggactgaaattctaagaaattccggtttccaaacggaagccgctttaatcggaaatattgcgaatggcgtgatttcggtattggcaacattcgtcggaatctggctgctgggaagagtggggcgccggccgatgctgatgacaggcttgatcggtacgacaacagcgttattgctaatcgggatattctcacttgtacttgaaggatcaccggcacttccatatgtagtcctgtcattaacggtcacatttcttgcttttcagcagggcgccatttcaccagtgacttggctgatgctatctgaaattttcccgcttcgccttcgcggactgggaatgggtgtcacggtattctgtctgtggatggtgaattttgcagtcagtttcacgtttccgatattgctggcagctatcggcctgtccacaacgttctttatcttcgttggattaggaatttgctctgtcctgtttgtgaagaggtttttgccggaaacgaaaggactttctcttgaacagctggaggaaaacttccgtgcttatgatcacggcggggcgaagaaggattctggggctgaagtgattggataattaaaaaaagaatccgcacccgagtgcggattctttttggtttcaaattagttaggtctgacaaggattttgacttggcttttctctttaataagagccccgaagccttcctcgatcaaatcatctagtacgatttttttcgttacgagtttgtcggctgagaaatagccttctttcattaatgacaatacagccgggaagatgtcacggtatccgataattccttttactgtacgttctttgattacgatatcgttcggatggatttcagcacctttttcccaaatgctgacgatgacggtttcaccggcaattgtagtggactggatggcttgtcgtaacaccactgggacaccagtgacttcgaatgctacgtcaacaccgcctcctgtacgttctgcaatctcagcgactacatcgtctgttttagacggatcaacgatgatcgcgccaagctcctcagctttttgctggcgttcaggagaaagctcaacagcgtaaatatcagttgcaccggcagccttcagcgcttcaatgacaagaagtccgatcgggccgcagccgaatacagccgctttgtcgcctgctttgagtttgcttgagcggacagcgtatagagcaactgcagaaggttcaacgagcgcgccttgttcatatgataattcatcaggaagtttgaacaaaagctcttcatctacagagacgtattcagagaaaccgccgcctccgccggctaagccgaggaatcccatttgttcatcaaggttgtaggcgccttggtggccgtgtgtagcaaaaatcggctcgactacgacgcggtctccaactttataattttcaacgccttctccgacttcgacaacttcaccggagaattcatgccccattgtgacaggtgccgtttcatttgttaatgggtgcggtttgtcaaccggaataaagatcgggccgcccagatattcgtgtaaatcacttccgcagatgccgcaccatttgactttgatctttacttttcccggctccgtttttggctcttcgatatgttcaatacggatatccttttggttatgccatcttgctgccttcatggattaccactcctataacttttgatgtgagtaattccgcaccggtcaatatgaactgttcacaaaatcgccatttttaaaaccaaaaaagaaatgaaatttttatataatataatctacgtttttttgaaaaaagaaactttgaagaaaaaagggtctcgcacactcttttttctttatatgagagtatcaatcgtttacatagctatgaatttggtttgaacaatacggtaatggttcgttcatattgaatgcgacaactactctatcaataattataacgctaatactgctattataataggataatcttccatggtttattttagcagagtaacttttttgactttgtaacattactgtaaggatattgaaataaaaaatagctggttgatcgtgtataatcttcctagatgttaacaaacagggggacgaaatgttgaagaaagtcattttagccgcttttatcttagtaggaagtactttgggagcttttagtttttcatcagatgccagtgcgaaacatgtgaacggaaatattacttggtataatggagtcgggaaaaaaggctcttcaggtaagaaacttggacattgggattgtgcgaccaaaatcggatttgatgttcctagaaacgggacaaaaatcagagcttatgcaaaagcgaagcctaaaaaggtgattacggtttataaaaatgatgttggcagaatgcctaatgcagtgctggatgttagccctaaagcgtttaaagcgcttggatatccattaagcaaaggtaaagtagcggggcattacagctattaatgtacatatataatctggaaagcaagaagtcacattcttgctttttctattggtggagataaaagatgaaaaaaagaatcatattattattagcagtgataatagcggcagctgccgcgggggttgcgttttatgttgcaaaggataaaggctatgagaaggctgctgatgtttcagtcaataccgaaagcggtgatgagctgctggtttcaattacagatacggatctgctgacaaagtattatgaaaatgacaaggtgatccatgaggagaagctgaccagctatccggcatttgccttggatcaaaaacagcaggtgctctattatacgggcaataatgaacagaatgaaatgaggctttttaaattggatctgaagtctcataaaaaaacgatgctttataaaggcgcggagagtgcggacagtttgtttttatcaaaggaccgttcaaccatctatttccgcttaggaaaagcggacgaaagcaattttcggatcgccgcttttgatctgaaaacgaaaaagtacaaaaatctttatcctgccgctaatgatcaggataacaccgtcagcagcttcttttataaccaaaaaaacgattcatttgcattgcttcattattctgtagaagaagactacaagaaaacagatgaagcaaacgaaaagggcatcgacccagaaccgacaacgattcattttgcggaaggccgccaaaataaatttaatgagctgaaaagcctgaaccaatttatcagcgatattgctgtttctgttgatgataaacgtattttattcacatcatatacgcaaaaaggaacggagcaaaccgcttctattcaaatgctcaatgcggatacgaaaaaatatgaaagcatcatctcaaatcaaaaatcatttaagctgttaattgacgcacagcctcagttctctaaggatggaaagaacatttattttcttgccgaagccaagggggctaaaaagctgaaggacgaaacagggcgtgaagctaaggtgcggacgatttattcctatagccttgaaaataagaccttcaaaaaagtatgggaaaatccgaacggcatcatcaacagcttttctgtgattaactaataaaaaccactcggcataagctgagtggcttttttaatggacgaggtgcagggctaatgattcgagccatttaaagatatgaatcagaggtaccgacaaaaacagaagttcaacatatgagttcattgcaacattcagctttttgaacgcagctctttttttcaagtctttttgctgctggtttgagatcacgttatcactcctcgtatatccatattataccattgaaacagacaaaaaaagccctaaacgtttacagttttgggcttctttcttcgtatttggcctcttgcaatgagaggcttttattctgaaatatagaattttgtctccgttcggggtttgttgcttgcgggagactgcatttgttatagggaagaactagcttgttttcgtttggctgttgttttggagattcactaatgaacggatgccgtcgaccattttacttccgcacaaagggcacaatggcgtatcactgctggcgaagttttttcgggtccagccattacagtcttcttttgtgcattcccaagtactcacatcttcttttggcagcggttcttgatttcgtttgttatagtaagacataaagtcacttcttccctcatgtattttactgcacatttcttattgtctcatacttttccctaatctcctaattcctttttctttatgactttccaataaccccatctaaaaaggagaggagtgtgctgttaaaagcatctggctcttctaaaaacgggcaatggctgcttttaggaaaggtaacgagtgtcgcgtttggaatattgctgcgcaagtgttccccagctgctgtagagaaaaatttcttgtcttccccgaagcacagcaatgtcggcacattgatgttttggagggtgccccggtaatcagcggccgtttggttaaataaaatcgtgctagaaatggcagccggctgtttgaggatttctgccagcatccattctgtttcggtctcggcaggcggttctgcgaacatattctggatgaagctttcgtagaaaggcagcgggtcagtttgaatggcgtgcatcgctgtttttaagccgtcaaaatcaaatggaccatgttcccagccctcccattgatagtccgaagcggattgatcgatgatcacagcggcttgaatgttatcattcccaaactgattgagataatcccatacgacaaaagcacccattgaccagccggcaagaacgacatgatcaagctccattgcatttagaaattcccttatgtcacgggcatattgggaaatggtgtggccgtgaagcactttgtcagattcgccgtgtcctctaagatcaagacgaatacattgataattggcagaaagcgccgaaaattgtttgtggaaaaattgtccgctcatcagcaccccatgtataaacaggatcggcgtcccgctcccgtgtgtttcatagtaaaggcgtgtctgatcttctaatgtgatgtatggcatgtttctcctcctttagtttccatcatgagtatggctggctgctgttgagctgatgatgacagctgtcgcggctgcctgctgcgcttgaatggctgtttcgatagcggtgtatagtcctgattccatcagcagatttttctccatatgctcactgagatagaggctgacagcaattttaaaattcatttccttttgccatttaaaagctttttcctggtttaattcgtcagtgatgcacaaaaccgttttgatatctggctcttccagaaatgtgaggagagcaaggtctggataatgataatcctttggttttttgacagattcagtgatcgattgatatatctgtttgcaagcggaaacaagcatttcgggctctttttcactttgcaaggccagaatatggctgacctgatgtaagtactgtccttttttaaagccgttggctgccagcagctgatagcatgtttccgccttctgtagcgcctgcaaaccttctccgttttctccaagcagtacggcaagcggaacattctgagttgaagtgaggaaataatgatttttcttcatctgctgataaactgctagccccatgttcatctgttctttttggtttgtcgtttcagattttccggtgagcaagatcagagcggaaaggtatgtgaacatatcccgcttatatcctagcttcaccatttcattgtatacatcgataaaagtatgaaatgtttgttttgcctcatgctgaaaatgaatgtccagaatagatgcaacagtaaagcggtggtgtgaattgagtgttgagaagctgccgatgtttgatttgatatagctgctcaaatcataaaagcgctgaaaatcaaactctcttttattcacaatatatgcagaagaaatgagcattaatatctgatcgtgtgaaactttccattttaattttgattttaatttagcataaatggaaatgtattgctttattttttcatgtagatcgtgtgtgagcataaaaagcagctccttttgttgtttttacgtaatacgataaatagggccaaaggtttcataaagaaaaaacttgcctgctagaggcaagtttgtcggattatttatggggatctgttatatccatcggtctcatcatgtcatagtcttcatgctctagaatatggcaatgccatacgtatcgtccgctgtacggaccgaatgtcgccgcgattctcaggacttcacctgcatgcgcttgaatggtgtctttccagcccttttcacttggcggcggcgggacagccggaccggtataggacaattccccgctttcttgataacgggcgatatcaaacggccgccggtctaatacacggaaggagactagatgcaggtgaatcggatgtgttccgcgtgtcgggttgataatggaccatatttcagtagtgccgacttttggtgcttctgtgacgggatcgtgccagcgtttgttattaagcagaaggacgggtctgccgtattcgtcctgggtgcctgccagttttaacgttctgatgttttgtattctttcatgctgtaccgaagggtatgaggcgaggtacttcggctttctgctttcgtctttttgtgccaatggttttgtgactctgaattgcatgatattagcatctgtttcaggattgacgtcaccgccacagcccgcgctgtttgccaaaatgatcgattctccttcatatgctgtgaagtcaatgatgatatcgtaacgttcagcaggcgcaaggctgaaagaattcagtttaacagatcgcggcaggagacctccatctgaaccaatctgaataaactctccgccattatcgagtgacaggttataggttcttgtattggaggcgttgatgactcggaatcggtatttcctcggctcgacctccaagtatggccataccttcccgttgacgagtatggtttctccgcaaaaagccggaacgattgaaggattaggcagtgacggagaagggttttccggtgcgctcggataaaacaaagaaccgtcctcattgatcgtgcggtctgtgataagaagcggcacatcgtattcgtctgaaggcagttttaagcgtttttcctttgggtcatgaatgatataagcaccgacaagtccggcatagacatttagcctggtgagcgccatggcgtgatcgtgataccacaatatagccccgcgctgctggtttggataatgataaacctctcttttgaaataaggtcctgtttgttcaaagtctttggaaaaccaagcctcgggatacccgtcactgtcatctggcgtgacgccgccgtgtaaatgaacaacagtctttacctcggactcttcatgctggctgtcactgtgatgaatggtgtgatcaatcggaaggaaatgcgtggaaggtaggttattcatccattttacatatacgttttcatttcttttaacctcaatggtcggtcccggaaataagccgttgtagccccacaggcgggtcggagggagatcgcgatggagctgatgggtgcattcctccatggtcacttcgtagtatgttttttcttttgattgctgtactggctttagtgtatctgggattgggagagcatccacaaatttttcaagtgtcattttcatctgtccttatctaaattttccaaattggtactatagttaatgacaataaggacgtgatggttacaaaaaatcttcgtgctgcagactgcccgagaaagaaaataacaaaatcctaaacggcagtccgtttaggatttgatcagcattaaggcaggatatcgggttgctgctgtgtgactgggttggcagccgctttctcgctcaccttgcgttttctgaacacaaggtaagaaatcagaacgattcccgtgatgacgcctgtcagcagcagctcgtctctcatggaatcaataaacgccatggacactaaaattccacaaatggcgatgatggtcaagtaggttaggaaagggaagagccacattttgatcttcaatgcttctgggtttgttttttcgagttttttccgcattttcagctgggaaacagcgatgacaagatagacgagtaaagcgattgcgcctgatgagttgactaagaataaaaagacggtatccggtgaaaaatagttcattacgaccgcgatataagagaaaaatgtgccggccacaatggcttgtacgggaacgccttttttgctcaatttcataaaacggcgcggcgcttcgtttctttctgcaagtgaatacagcattctggatgtggtatacaaacctgaattcaggcaagagagtacggctgtgaggacgataaagttcataatctgtgcggctgcgggcactcctatatgctcaagtacagcgacgaaagggctttctaaaatatttgctgaattccatggcaacagcgccacgacaatggcgattgagcccacgtaaaagacgatgatgcgccatacaacggatctggtggcttttgtcacagattcgatcgggttggatgtttcccctgctgcaatggcaacgatttcagttcccataaaagagaagatgacaacgacaatgccgagcaatacggagctgatgccctccgggaaaaatccgcctttgcctgtaagattcgaaaaaccgactggctcactgcccggtgcaaagccaaaaataaaggcaaaaccaacgattagaaaagcaatgatagtcacaactttaatgagggagaaccaatattcaaactcaccgaaagacttaacggagtagacgtttgtcagggtgagcacaatggtcaagatcaaacttgtcagccacagcggaatatcatggaaccagtattgaataatgccagcaccggcaatggcttcgatcgagatgacgatcacccagaaaaaccagtacagccagccgattgtaaatcctgcccacggtccgatggcgtcgtgagcgtattgagaaaacgatccgctcgtcgggtttacggcagacatctcaccgagcattctcataataaaaatcaccaataatccggctaacgcgtaagaaacaacggcacccggaccggtcgagtgaatcactgaaccgctgcctacaaataggccggctccgattacaccggcaatcgaaatcattgtcatatggcgggtctttaattccttttttaatcctgattgagattggttcataagttacctccttttaaaatgcaatcattactgaatattatgataattgaaactctatcataaatatacagtttgtcgaaaattcatgtgagaaaatataacgttttatttcaaatttgtagtgttttgtttgcgctttcagcgaatgtgtggaaaaaatgtttcgttttttatttgctgtgtgattttgtgtactatttacaattcgatagaatgcgagaagcgctggtgtcattggatctgatgggctttttggcggagcaaataaattggatgagagaaaaagtgttccatcgtcactatttttctgtggcgggtgaatcatgtttctgtagacccactgcggttcagctttgtaagataataataggaaaatgtgagcggggaggaggttttgtatggagagatatgatgaactgaaaaagggagaatccggggcgctggtcagcattgccgcgtatcttgttctttccgcaattaaactgatcatcggttatctttttcactcggaagcacttacggcagacgggttaaataacacaactgacattattgcttctgttgctgtgctgattggcctgcgcatctctcaaaagcctcctgacgaagatcatccatacggccactttcgagcggaaacgattgcatcgcttatcgcatcgtttattatgatggttgtcggcctgcaagtgctgttcagtgccggagaatctattttttctgctaaacaagagacgccggatatgattgcggcttggacggcagcgggcggggcagtcctgatgctgatcgtttatcggtacaataaaaggctggccaaaaaggtgaagagccaggcgctccttgctgcggctgctgataataaatcagacgcattcgtcagtatcggcacatttatcggcattgtggctgctcaattccatcttgcttggattgatacggtcactgcgtttgtgatcggtctgcttatttgcaagaccgcatgggatatttttaaagagtcatctcactctttgacagatggattcgacataaaggacatttccgcttataaacagacaatcgaaaaaatctccggtgtgagccgtttaaaagacataaaagcaagatacttgggcagtacggttcatgttgatgtggtggttgaggtatcggctgatttaaatattacggaaagccacgatatagccaatgaaattgagcggagaatgaaggaggagcatgcgattgattattcgcatgttcatatggagcctttagaacaaaaataatggagcttcctgccacaggaagcttttttgtgtgttttggccagctttattggaaacaatttgctagaatcgtttttttatacagattgctttttgtggtaaagttaggttacattatgatgaattttgtagatgactaggaggaaaagaatggcatatcaagaagacctgcatcctttgctggggaaagcagttgaacatattaatagagtaatggttggaaaacgagacatcgccatactcagcttagcagcccttcttgcaaaagggcatgtgctgcttgaggatgtacccggagtcggaaaaacgatgatggtccgcgcgctggcaaagtcaatcggcgctgatttcaaaagaatccaattcactccggatttgctgccatctgatgtaacaggggtatctatctataatgcgaaaacgatggaatttgaatatcgtcccggcccaattatgggaaatatcgtgctggccgatgaaatcaaccgtacctctccgaagacacagtcggctttgctcgaagcgatggaagagggaagcgtcacggtagatggccatacgatgcagcttgccgctcctttttttgtgatggcaacgcaaaacccggtcgaatatgaagggacctatcctttgccggaagctcagcttgaccgttttttattcaaacttcggatgggttatccgtcctttaatgaagagcttgacgtcttatctcttcaggaaaaaagccatccgattgagacgcttgagccggttattgcaaaagaagacttcatctgtttacagagggaagtgcaaaatgtccgtgctgatgacagcattaaggaatatatcgttgaaattgtgcagaaaacgagacagcatccttctgttcaattaggcgtcagtccgcgcggctcaatcgccctcatgaaagcggcacaggcatacgcgctgctgcatcatcgcgactatgtcataccggatgatattcaatatttagctcctttcacgctgccgcaccggatgatgcttcatcctgaggcaaaatttgaagggattcaggcagaagcgatcgtaagggagatcatgtcagctgtgaaggtgccggttcaaaggtcgtcggtccgctgatgaataagaaatggcaatggctcgtatatggttggaagctgattatattaactttattgacggctgctgttttttcttatgcgatgtttcagggcggctttgtcagctggtttttgttttacgcgtttctcccttttgtcttgtatgccgggctgttggccttgtatccgctccgttcttttcaggcttcaaggcaaatggataaaacacaattgcatgcgggggacaggctgggtgtaacggttacgctgagaagaaagctgccattccccctgatgtatatggtgattgaagattgcctgccagaaggtatcgagtcattaaatcgagacggagccgcggccaaacggctcgtttttccttggtttaaacggagcatgacgatgtcgtatgaattagctcgggtaccgcgcggagagcatcactttcattctgtcagggtgcgaaccggggatgttcttggcttgattgaaaaaacagcattttttgagctggatgataccctgtttgtttatccattctatcagcgtttttcctatcaggtgaatgagaggcatcaggaagacggtgtaagcggttcttctcctattcatcagcaccattcctcagtcgcagcaagtgtgcggaattatcagccgggagaccgatttgctgcgttagattggaagacatctgcacggcggagccagctgatgacgaaggaatttgagccttctcgcagcaaaaatctgtttctgctgatggaccgtttttcctcagacgcattcgaagaggtcgtttcagtgacagcttcgattcttcattctgttttaaaaaacggcgcgggtgctggtctggcttccatcgggaaggaaaaaaacattttccctattcaggaaggggatcagcattttaagcacatgcttcggcatttagccatcgctcattgtgatgcggcagacccgataagccgatatgcacgggaagagctgggaaagccatctgttcgccaagctgatcaagttgttgtcacgggacagttaacggaagatatgctgcacctcgcagaaataggaggcggccgggttacggtgatactggcaaaagagaaagatgctgagctctctcaagctgaaaatgtcatgattgaacgcatgatgaaacgccaaatcagagttcgggtcatgaggggcgggcgagtttcgcgtgttgtttagaaagagaggtgactggttcacatgccgcacgatgatcacaaggggagccgtttgagcttgctgttattttattttctggcttttttattgctgtgggagtggctcaggccgcttgacagttttactgaaacgaaacatacaggcttttttagtgtctttatcggcttgacgtttctgctgacttttttcaggatgaggtggtttgttaccgttcctttttgtgtcttatttacattgatctcgatacacatcctgttttatcaaggatctatattcgacttgagctgggtcagctcttttttgcaggatgtctatctgaatatcacgctgattcaatctgggcaatggaatgacatgattccttcatttcggaccctgctgttttttgtgctgctgtggctgctggtctatctcctgcattattgggtgatttaccagagaagaattttgtttttctttatgatgacagtagcgtatattacgattcttgatacctttacgccatatgatgccacttttgccgtcatccgtatcgtgctgatcggcttctttatgctgggccttttatacttggagcgcattaagctgatggaaagaatcacactgccaaaaacatctgtcctgaaatggtttcttcctttatctgtattggttttggctgcaacgggattcggactcgccgctccaaaatcagatccggcctggcctgatccggtgccttttcttaaaaaaatcactcatcaagaccgcgtgtctgcaggggaaagcaaaatcggatacgggaatcatgatgaatcactcggcggcccgttccagcaggatgctacacctgtttttacatggcagggaaaagagcgtacgtatttccgtgtggaaacgaaggatacgtataccgggaaaggctggattgaaacagacacaggcatgtcgtatcagcttagcaatggaaaagttgaaaatctgtggtttgaccataaggttgcgacagagcgccgcaccgtccgtgtaaaagtcgataagcactacgggtataatcatctgatgtatccgattggtgcggaaaccattcagccaaagcaggctgtctcacttgaaatgaacggcaacacggagcaaatttctccgatcagtgaacaagccggtgaaatcagaaatatgggaaattatactgtaacgtacaattccccggtctataagctggatgaactgagaaaggtaaaagtgagaaaaaacagtgaggagtacacattcagcgatcgctacatgcagcttccagattcactgccagagcgggtgagaacccttgcgatcaaactgactcaggatcacgacaatatgtttgataaggtgaaagcggttgaggactatttagggtcaaatgcgttcacatatgaaacagaaaacgtgaccattccgaagaatgatgaagattatgtcgatcaatttctctttgaaacgaaaatgggttattgtgataacttttcttccgccatggtggtgctcttgcgctcggccgggattccggcccgctgggtaaagggttatacgtccggcgaatacaaagaagcaggaaacaaaaatggcaacatctacgaagtgacaaataacaatgcccattcctgggtagaggtgtatttcccggaacagggctgggttacatttgagccgactaaagggtttacaaatccggctgaatttacttcttctcacacaaaggactccggcaacgataacagcagctcgccgaagaaagcaaaacagaaagaagaggaaaaacagccgcaaaaagaggaaaaacaaaaggaaaagcgggagccagctgtttctaaaaagccgtccgcttcgcatactaatgccggtgcgggcttgtatgcagcgcttgcggttcttgcagtcctcttggtggcagctgtattgctgtatgttttccgctcgttatggattcctgttttcaccgtgaggaaattgaagcggcgcagcgatcagcacgcgttttttgaggcatatgacgcgctgctgaaacaactgaagagaaaagggctgccgaaacgaggcagtgaaacgctgcgtgattatgcaaaacgaatcgatgaaaaatacgacatagaagacatgtcaaagctgacattaagctatgaaagggcgctttacagaaatgaagattcttcagcgctttggaatgattccagagagttatgggaaaatttaattaaaagaagatggtcttgaccgcttatcaacgtgttgttagaattagtgaatattatcggagtctgggagcgagttggcctgactccggcaaacggccttgccaaagagggcggagcgagcttcatatctgtcctcgtttttttctgtgtcaaaaaacttagaggagattaggtgacaaccatgacaaagttagtgaatgaaatgattcttgtccttgatttcggcagtcagtataaccagctgattacacgccgtatccgtgaattcggtgtttacagcgagctgcatccacatacattgacggctgaagaaattaaaaaaatgaatccaaaaggaattattttatccggcggtccaaacagtgtgtatgatgaaaactctttccgctgtgacgagaaaatcttcgagcttgatattcctgttttgggaatttgctacggcatgcagctgatgactcattaccttggcggtaaagttgaagcggcaagccagcgtgaatacggaaaagcaaacatccgcatcgaaggcacacctgatttgttcaaagatcttccaaacgaacaagtggtttggatgagccacggcgatttggttgtagaagttcctgaaggcttcactgttgacgcgacaagccatcactgcccgaactcagcaatgagcaaagcggacaaaaaatggtatggcgttcagttccacccggaagtgcgccactctgaatacggcaatgatcttctgaaaaactttgtattcggtgtttgcgaatgcgaaggcgaatggtcaatggagaactttatcgaaatcgaaatgcaaaaaatccgtgaaacggtcggagacaaacaggttctttgcgcgctaagcggcggcgttgattcctctgttgttgctgttttgattcataaagcgatcggcgaccagctgacttgtatctttgtagaccatggtcttctccgtaaaggcgaagctgagggtgttatgaaaacattcagcgaaggctttaacatgaatgtgattaaagtagacgcaaaagatcgattcttaaacaaactaaaaggcgtttctgatcctgaacaaaaacgcaaaatcatcggtaatgaattcatttacgtgtttgatgatgaagcggacaagctcaaaggcatcgactaccttgcacaaggtacgctttacacagatatcatcgagagcggtacagcaacggcgcaaacgatcaaatctcaccacaatgtcggcggacttcctgaagacatgcagtttgagctgatcgagccgttaaatacgctcttcaaagacgaagtgcgcgcgcttggcacagagctcggcattccggatgaaatcgtatggcgtcagccgttcccaggaccgggactcggaatccgcgttcttggcgaagtaacagaagaaaaacttgaaatcgttcgtgaatcagatgcaatcttgcgtgaagaaattgcaaatcacggcttagagcgtgatatctggcaatacttcactgttcttcctgacatccgcagcgttggtgttatgggtgacgcaagaacatatgattatacaatcggaatccgtgccgttacatcaatagacggcatgacatcagactgggcacgtatcccgtgggatgtgcttgaagtcatttcgacacgtatcgtaaacgaagtgaagcacattaaccgcgtggtgtacgatattacaagtaagccgcctgcgacgattgagtgggaataagtaaataacaatgagaaaaacgtccctttttcaaaaggggcgtttttttgttaactttttgaaaccgtttcgacaatttttgtatctaacaacataggaggtggataaggtgaaggaagacagattgattacaaaggcgagaaaaggaaatgctcgggcctttgaaaagcttatgctggcacatcaggagactttatataaaacagcttatctctatttaagaaataaagaagatgcacttgatgctgtacaggaaacggcttataaagcttttataggtatagaaaaactaaaagagccaaagtactttttaacgtggctcacccgaattcttattaattcaatttttgcaatgaagaaaaagaagggggaattagttccgtttgaaagccatcatgacactggcacggaccaaaggaatattgaagaatatatagacttgcgcaatgcgctggatacacttgatgaacatgttcagttaacaattcagctctattattttcaagattattcgatttcaatgatagctgaacaaacaggaatggcagaaggcacaattaaaacccatttacatagagcgagaaaagcattgaaacaggagctggaaaaggaggatcaaaacaaatggacaaacaccaaatgaagcagatatttgataacattgaagtgccaaagaaagtactcaaaaaggcaatacatcaagctgtcgttcgtgctgaaaatgaaagtaacacaaggcgccgttttaaatgggcacgaactattacaaatggaatggctattgctgctgtggtatgtatattgtatttatcatctggtctttttcttccctctgtaaacaaagcgatggggagcatacccattgtcggacaaatttataaggattttcaagataaagttggtctatcattgtttaaaagcaatttggtcacagctttaaatgaaaaagcagactccaggggaatcactgtttcggtaaacagctcctattacgatgccgggcagcttgtgtataactttactgttgataacctccagtctgatgaaaaagagctcagttataatgtgagtaaagcgagttttaacaataatttttcaatcaactacgattccttaatgctcaaaaaattaaataacaaacaatatgctggtcaattaaggctttatacaaaagggacagaaataaaaaatggggataccgtgccttttgtgattactcatatcaatgaaatacagggaaattggagattcaaactgcctattaccaaaaagaatgcgagttatttagaaagctcaaaagtggtatcagtgcttaacaatcattatcaattttccaatattcaagtggagaacggaaagctcggatctgtccttcaatttacaatcgattatcaaggcgtagcaaagcatgatacggttgaaattaacgaagtcaaagatgatttaggaaacacatatgagatgacagcgtcaaacatccaacttggagaccgcaaaaaagtaaacgagagaacggtaagagcaaaaggacaaacacagttagaatcaccaattaatccaaaggcaaaaaagctaacattaatagcaaatattaaatctgaggcagagggcagtgaaattgtcccgctaaatgcagagatgccgtttcatgtttcagaaacaaaccatcaaaacatagggattgaaatcaataacattaaccaaataggaaagaaagtattggttcattaccatttcactggaattgatacctcaagcgtggacgaaaataaattagtgaatatcggtgaaacgattggccttggtgatataaaaaaaatgcaatcttggcctgatccagtaggtgattatgaagaaggttattatttgaaatggaataaagctgaagtgaagaatatggacacagccgaaatggtatctacttttgaactggatgacgcttatcttgataagctgtctttaaagcattttgagtttaatgaatacggtctgtatattgataaaggcgttttaaatgacctgattcaactaaagccattctcgtttactgtaccagtgcatcaggtgagtcagcctaccgaaaaaaaataatcataagttgaaaagccgtatgttgccatacatacggtttttatcattgttaccaatttagtcaatagacgaataaaccaatttttttaataagtaatgttcgttgtttatattgtcaattcaaaatgaacttggtacaatagacacagaaatcaaataagatgaattcgtataatcgcgggaatatggctcgcaagtctctaccaagctaccgtaaatggcttgactacgtaaacatttctttcgtttgatataaataaaacacgtttatttattcaaactgaaatccgtctgtagtcaagcgtcccaaaattattggggcgttttttatttggcgatttcaggacagaataaatagcaaagagtgaagggagtcaaatagcttgaaaaagtattttcagtttgatgagctgggcaccagctatcgcaatgaaatcattggcggattaacgacttttttatctatggcatatattttgttcgtcaatccgattacgcttgctttggacagcgtgaaagattttccggaggcgctgagaattgaccagggtgcggtctttacggcgacagcgctggcgtctgcagcaggctgtatcttaatgggattaatagcgagatatccgattgccatcgcgccgggtatggggctgaacgcgttttttgcgttttctgttgtccttggtatgggtatttcatggcaggcagctttgtctggtgtttttatttcaggtcttattttcgttgctctttctttaacaggttttcgtgaaaaaatcatcaacgccattccgcctgagctgaaattggcagtcggtgcggggatcggcctgtttattacattcgttggcttacaaggctcaggaatcattactgcaaatccttctacgctcgtcacgatcggaaacattcacagcggtcctgtgctgttaacgattttcggtgtgattgtcacggttattttaatggtgcttcgcgtgaacgcaggcgtgtttatcgggatgctgttaacagcggtagccggcatgattttcggtttggttccggttccgactcaaattatcggcagtgtgccaagccttgcgccgactttcggacaagcgtggattcacctcccggatattttctctgtacaaatgctgatcgttattttaacattcttgtttgtcggattttttgatacagctggtacacttgttgctgtggcaacacaagctggtttaatgaaggaaaacaaattgccgcgtgcgggccgtgcgcttttagctgattcatcttctattgtgatcggtgccgtgcttggtacgtctacaacaacttcttacgtggaatcaagctcaggtgtcgctgcgggtgcccggtcaggatttgccgcaattgtaacagggattctctttttactggctacgtttttctcgccgctcctatcagtcgttacgtcaaatgtaacagcgccggcgcttattattgttggtgcattgatggtggcgccgcttggcaaaatcgcttgggataagttcgaggtggccgttcctgctttccttaccatgatcatgatgccgttaacgtacagcatcgcgactggtattgccatcggatttattttctatccgattacaatggtgtgcaaaggaaaagcaaaagaggttcacccaatcatgtacgggctgtttgtcgtatttatcctgtactttatcttcttaaaataaggaatgaaaaaccagctgcaccggcagctggtttttttgttgcaatagataaaaccatttcatacgatataccgtcatgtagatgtgccgccatgctttacttaaatggaaatgacttgactgttcaggaaggcttcggtaccttatataagtgttttattttcttgctgaatggtattccgccgtatttttttgataggagttgctgacatgacggaagaaagaaaagaaacgtttgaagaagaaattaaccagagtgaaagaatagatgcagatgaagaaccgctatcgagaatgtccagaaaggcgagccggcaaagcaagcagaagcaaaaacaaaaacagaaaccgcgccaggaacgcggtgaatcaactgttaaagtcaagcttgcgtctgtttgggcagccatcaacagatattgcggttttgcgttctcgattttaaaatctccggcgaaaactgtcgtaacggatggtttttctcattataagtacggtctgatttcaatgcttatattcagtatcattttttcaattgggaattggtttcagttaaaggcaagctggaatcggccgctcggtttcggagaacgccatcatgctttctatgacgggtttttagttgttcttgtgtatttgctgatctttttcgcggtaatggtctttgctatatgggctgtctcccgctatatgatgaagcagaaggtgacgttcagagaagcggctgccgtattgggttcattgcttgtaccggtaattgctgtttcaatcctttggctgatctttgcgatcgtaaatattccaatgctgacagtactgtttacggtgctgatcttgttttccatcttttttatcatcgcgctgtatgtacagcgtgtgtaccaggcggcacaagatgcaccaattgattatatctattgtgtatttgcagtggttgcgatagcgctgctgtttacggcagtgacttggccgtttatttctgaatattttacggcgtcgctgattccgctttaatgaaaaaaccggctaatcctagccggtttttttatgtcacactttttacaaatatatctaaaaaacatagttgatttgtaggattaacccgtgtatgatggggaaaatgctgaaaacgtccagcgcaaaaacctttatgtttaaggaggatgatggacatggctgatgtgcttcgccgagcaattaaccaaaagaagcaatttttaaaaaccaaattactgctctcggaattttatcaaggaagaggggaacagcttgcggactacacgctgagtgagcttgagaaagaatacaagtcccttcagaaaatgaaaaaagagatctgacaatagatataaagaggtgagtctgctgaaaagcgggcttttttgttttgattttgaaaaggcgagaaagagggtaaactactactgttcaacgcataaaagcatgtcgaaatattttgcttaagcttacgggcgaagctgattgtaaacggctcatttctctagtagaatatgaatgctttgtgcaagctgaagagtagggggatgaataaaatgatgcaaaccatcttatcaaatgggatagccatggttctcataattctcattattaatattgtctatgtgtcattttttacgataagaatgattttaacgctgaaaggacagcgttatttagcggccggcatcagtacgattgaaatactggtttatgtgacagggctgagtctggtgctcgataacttagatcagattcaaaatgtaatcgcgtacgcgctcggttacggtcttggcgtaattgtcggcatgaaaatagaagaaaaattggcgcttggctatattatggtcaatgtgattacgaaggagctcgatcttgatcttccgaagcagctccgcgaaaaaggctacggcgtgacaaattgggtggcaggcgggcttgaaggcgaccgcacagcccttcagatcctgacgccgagaagatatgaactccagctatatgatacgattaaaacacttgattcaaaagcctttattattgcgtacgaaccaaaaacaatccacggcggcttctgggtcaaagcggtgaagaagaggagaattaaagaataatggcaaagccgaagaagaaaaagtttgaagtgacagagcagcaaacgattgatgcggtgcttcagcaaatgaaagaagaaggatatctgcctgtaaggcgaatggaagagcctatttttatggaaaaaaaggaaaatgggtcaattcagatcgttccgtgcgggaaaaaaatcgtatttgaagggaaattgatctaaaacacgaacattagtagaaagaatttttgtatcgttcgataatatcgttgacattatccatgtccgttgttaagataaacatgaaatcaaaacacgacctcatataatcttgggaatatggcccataagtttctacccggcaaccgtaaattgccggactatgcaggaaagtgatcgataaaactgacatggatatatcgcagaagcgaacgactgacgatacatgtaccatgcccggtttgtattgcttcctcataagtgcaatgcagagcgggtattttttattttctgaaaacaaaagcattagaaggtggggaacagaatgcagccgctagtaggaatcatcatgggaagcacttccgattgggagacaatgaaacacgcatgcgacatacttgacgaactcaatgttccgtacgaaaaaaaggtcgtttccgctcaccggacgcctgatttcatgtttgaatatgctgaaactgctagagaaagaggcatcaaggtgattattgccggtgccggaggagcggcgcatctgccagggatgacggctgcgaaaacaacactgccagtcattggagttccggttcagtctaaggcgctgaacggaatggattcacttctttccatcgtccaaatgcctggaggcgtgcctgttgcgacaacatccatcggcaaagcgggtgctgtgaacgcaggcctgttagcggcgcaaattttgtcagcatttgacgaagaccttgcccgtaagctggatgagagaagagaaaatacaaaacagacagtgttagaaagcagtgatcggcttgtctaaacaaatcatctatccgggagctgtaatcggcattatcggcggcggccagcttgggaaaatgatggctgtgtccgccaaacaaatggggtataaagtcgcggtcgttgatccggtgaaagattcgccgtgcgggcaggttgcggatatcgaaattaccgctcattataatgaccgtgaagcgattcgaaaattggctgaaatcagcgatatcatcacatatgagtttgaaaacatcgactatgatgcgctgcattggctgaaagatcatgcgtatctcccgcaaggaagtgagctgctgctcattacccaaaaccgtgaaacagagaaaaaagcaattcaatccgcgggctgtgaagtcgcaccgtacagcatcgtcaaaacaaagaatgaattgaaacaggcggtacaggagctcgggttacccgcagttctgaagacatgccgcggcgggtacgacggcaaaggccaatttgtgataaaagaagaggcgcaaatggagcaggcagccggtctgttagaacacggaacttgcattcttgaaagctgggtttcttttgaaatggaactgtcggtgatcgtcgtcagatcggtaaacggtgaaatttcaacatttccgacagctgaaaacattcaccacaacaatattcttttccaaagcatcgtgcccgcacgggtagagaaagggattcagcagaaggctgctgatctcgcagttaagcttgcagatgagcttaaccttgtcggaccgcttgctgttgagatgttcctgacagaggacggagagcttttggtcaatgaactggcgccaagaccgcacaattctgggcattatacgctggacctttgcgagacgagccagtttgagcagcatatcagagcggtatgcgggcttccgcttgggaagacagatttgctgaagccgggcatgatggtgaatcttctcggcgatgaagtgaagcttgtggaggaagacccggagcttttaaaagaggcaaagctatatatatacgggaaacatgaaatcaaaaaaggccgcaaaatggggcatattacatttatgaagcagcctgaagacgaatggattcaggagatcacaaataaatggatgaatagagacggaggacaagcagaatgatcgaacgttattcaagacctgaaatgtccgcgatttggacggatgaaaacagatttcaagcatggctggaggtagagattcttgcctgtgaagcgtgggcggagcttggcgtcattccgaaagaagatgtaaagattatgcgcgaaaacgcgtcatttgacatcaaccgcattttagaaattgaaaaggacacgcgccatgacgttgtcgcttttacacgcgctgtttccgaatcattgggcgaagaaagaaagtgggtgcactacggattaacgtcaactgacgttgttgatacggctctttcctacttattaaaacaggcaaacgatattttgctcaaggatcttgagagatttgttgacattataaaagaaaaagcgaaagaacataaatacacagtcatgatggggcgcacgcacggcgtacatgctgagcctacaactttcggcttaaaacttgcgctttggcatgaagaaatgaaacgtaatcttgagcgcttcaaacaagcgaaagcaggcatcgaggttggaaagatttctggcgctgtcggcacatatgcgaacattgatccatttgttgaacaatatgtctgtgagaagctcggattgaaagcagcaccgatttcaactcaaacccttcaacgtgaccgccatgctgactatatggcaacacttgctttgatcgcgacaagcattgagaaattcgctgtggaaatccgcggactgcaaaagagtgaaacacgtgaagtagaggaatttttcgcgaaagggcaaaagggttcatctgcaatgccgcataaacgaaatccgattggctctgaaaacatgacaggcatggcgcgcgtgatccgcggctacatgatgacagcttacgaaaatgttccattatggcatgagcgcgatatttctcattcttcagcagaacgaattattcttccggatgcgacaattgcgctgaactacatgctgaaccgcttctccaacatcgtgaagaacttaacggtcttcccggaaaacatgaagcgcaacatggaccgcactctcggccttatctattctcagcgtgtgctgcttgctttgattgacacaggccttacacgtgaagaagcctatgatactgttcagccgaaagcaatggaagcgtgggaaaaacaagtgccgttccgcgagcttgttgaagcggaagagaaaatcacgtcacgtctttctccagaaaaaattgctgactgctttgattacaattaccatctgaaaaatgttgatctgatctttgaacgtttaggtttagcatagaagaagcttttagcggcttcttctaagccgccgatgtttgaaaattcccaacattcgggttaggaggccttccgtgaatattgtgaagaatgaacttttatacgaaggaaaagcaaaaaagatctacaaaaccgatgacgaaaacacgctgtatgtcgtgtataaagactccgccactgcctttaacggcgagaaaaaagcagaaatcagcggaaaaggacgcttaaataacgagatttcaagcttgattttcaaacatcttcatacaaagggcattaacaatcactttatcgagcgcatttcggaaacggaacagctcattaaaaaggtaacgattgtgccgcttgaagtcgtggtcagaaatgttgtggcaggaagcatgtccaaacgtctcggcattccagaaggcacggagcttgagcagccgattatcgagttttactacaaggatgacgcgctgggtgatccgctcatcacagaagatcatatttggcttttgaaagcggcgactcctgagcaggtagaaaccattaagtccattacaaaaacagtaaatgaagagcttcaaagcattttcgacgattgtcatgtcagattaatagatttcaagcttgaattcggtttagatgcagaagggcaagtgcttttggcggatgaaatttctcctgacacatgccgcttgtgggataaagacacgaacgaaaagctggataaagatttattcagacgcaatctgggaagcttaaccgacgcatacgaagagattttcaaaagactgggaggcattcatcatgtataaagtaaaagtttatgtcagcttaaaagaaagtgtactagatccacaagggagcgctgtccagcatgccttgcacagtatgacttacaacgaagttcaagatgtgcgcatcgggaaatacatggagcttaccattgaaaaatctgaccgtgatcttgacgtgctagtgaaagaaatgtgcgaaaaacttcttgcgaacacagtgattgaagattacagatatgaggttgaggaggtagtcgcacagtgaaatttgcggtgattgtgttacccggctccaactgtgatatcgatatgtatcatgctgtaaaggatgagctcggccatgaagtggaatacgtctggcatgaggaaacaagtcttgacggcttcgacggtgtgttaattccgggagggttttcttacggcgattacttaagatgcggcgccatcgcccgatttgcgaatattatgccagctgtcaaacaagcagcggctgaaggaaaacctgttcttggcgtctgcaacggattccagattttacaggagcttgggctgctgccaggcgcaatgagacgcaacaaagatctgaagttcatttgtcgtccggttgaattaattgttcagaacgacgaaacattattcacagcttcctacgaaaagggagaatcgattacaatcccggttgcccacggtgaaggaaatttctattgtgatgacgagacgcttgcttcattaaaggaaaacaatcaaattgctttcacatacggctctaatattaatggaagtgtcagcgacattgccggtgtcgtgaatgagaaaggcaatgtattaggcatgatgcctcaccctgagcgcgcggtcgatgaactgcttggaagcgccgacggtcttaaattgttccagtctatcgtgaaaaattggagggaaactcatgtcactactgcttgaaccaagtaaagaacaaataaaagaagagaaactgtatcagcaaatgggtgtcagtgatgatgagtttgcattgatagaatccattcttggaagattgccgaactacacagaaatcggaattttttctgtcatgtggtctgagcattgcagctataaaaactcaaagccgattctgcgtaaattcccgacaagcggcgagcgtgtgctgcaggggccgggggaaggcgccggaatcgttgatatcggtgataaccaagcggttgtgttcaaaattgaatcacataaccacccatcagctctcgagccttaccaaggcgctgcgactggcgtaggcggaattatccgtgacgtattttcaatgggtgcccgtccaatcgctgtattgaactctcttcgatttggtgaactgacttcaccccgcgtgaagtacttgtttgaagaagtagtagcgggtatcgccggatacggcaactgtatcggcatcccgacagtcggcggagaggtacaatttgacagcagctatgaaggaaatccgcttgtcaatgccatgtgcgtcggtttaatcaatcatgaagacatcaaaaaaggccaggcgaagggtgtcggcaataccgtaatgtacgtaggagcgaaaaccgggcgtgacggaatccacggcgctacgtttgcttctgaagagatgtcagactcatctgaagaaaagcgttctgctgtccaagtcggcgatccgtttatggagaagcttttgcttgaagcgtgtctggaagtcatccaatgcgacgccttagtcggcattcaggatatgggagctgccggtttaacaagctcaagtgcagaaatggcaagtaaagccggttctggtattgaaatgaaccttgacctgattcctcagcgcgaaacaggcatgagcgcgtatgaaatgatgctttctgaatcacaggaacggatgcttttggttattgagcgcggacgtgagcaggaaatcatcgatatttttgacaagtacgatcttgaagcggtttctgtcggacgtgtgacagatgataaaatgcttcgcctgacacacaaaggagaggttgtgtgcgagctgcctgttgatgccttggcagaagaagcaccggtttaccataagccttctcaagagcctgcttactatcgcgagtttttggaaacggacgttccggctccgcaaattgaagatgcgaatgaaacgctgaaggcccttcttcagcagccgacgatcgcgagtaaagagtgggtgtatgatcagtatgactacatggtgcgcacgaatacagttgtcgctcctgggtctgatgctggtgttctcagaatccgcggaacgaaaaaggcgctggcgatgacgacagactgtaacgcgcgttatctctatcttgatcctgaagtcggagggaaaattgctgtcgctgaagcagcgcgcaacatcatttgctcaggcgcagaaccgcttgcggtcacagataaccttaacttcggaaacccggagaagccggaaatcttctggcagatcgaaaaagcggcagacggcataagcgaagcgtgcaatgttctcagcacaccggttatcggcggtaacgtatcgctttataacgaatcaaacggcacggcgatctatccgacaccagttatcggcatggtcggcctaattgaagatacagcgcacattacaacacagcatttcaaacaagcaggagatctcgtatacgtgatcggcgaaacaaaaccagagtttgcgggaagcgagctgcaaaaaatgacagaaggccgtatttacggcaaagcgccgcaaatcgatcttgatgtagagctgtctcgtcaaaaagcactgcttgacgcgattaaaaaaggcttcgttcaatctgcgcatgatgtgtctgaaggcggcttaggcgtagcgattgcggaaagtgtcatgacgacggaaaaccttggcgctaatgtgactgtagaagggggagcggcattattattctctgaatctcaatcccgcttcgtcgtttcagtgaaaaaagaacaccaagaagcgtttgaagcaactgtcaaagatgcggttcatattggtgaggtaacagctgacggaattctggcgattcaaaaccaagacggacaacaaatgattcatgcgcaaacgaaagagcttgaacgcgtatggaaaggagctatcccatgcttgctgaaatcaaaggcttaaatgaagaatgcggcgtttttgggatttggggacatgaagaagccccgcagatcacgtattacggtctccacagccttcagcaccgaggacaggagggtgctggcatcgtagcgactgacggtgaaaagctgacggctcacaaaggccaagggctgatcactgaagtatttcaaaacggcgaactcagcaaagtaaagggaaaaggcgctatcgggcacgttcggtacgcaacggctggaggcggcggatacgaaaatgttcagccgctcctcttccgttcccaaaacaacggcagcctggcgcttgctcataacggaaatcttgtcaatgccactcagctgaagcagcagcttgaaaatcaagggagcatctttcaaacctcttcggatacagaggttttggctcacctgatcaaaagaagcggacacttcacgctgaaggatcaaattaaaaactcgctttctatgctgaaaggcgcctacgcgttcctgatcatgaccgaaacagaaatgattgtcgcacttgatccaaacgggctgagaccgctatccatcggcatgatgggcgacgcttatgtggtcgcatcagaaacatgcgcatttgacgtcgtcggcgcaacgtaccttcgcgaggtagagccgggagaaatgctgatcattaatgatgaaggcatgaaatcagagcgtttttccatgaatatcaaccgttccatttgcagcatggagtacatttatttctccagaccagacagcaatattgacggtattaacgtacacagtgcccgtaaaaaccttggaaaaatgctggctcaggaatccgcagttgaagctgacgtcgtaaccggggttccggattccagtatttcagcggcgatcggctatgcagaggcaacaggcattccgtatgagctcggtttaatcaaaaaccgctatgtcggcagaacgtttattcagccgtcccaggctctgcgtgagcaaggcgtcagaatgaagctgtctgcggtgcgcggggttgtagaaggcaaacgcgtcgtgatggtggatgactctatcgtacgcggaacaactagccgccggattgtcacgatgcttagagaagcgggtgcgacagaggtgcatgtgaaaatcagttcaccgccgatcgctcatccgtgcttttacggcattgatacttccacacatgaagaattaatcgcgtcttcgcattctgttgaagaaatccgtcaggaaatcggagccgataccctctcatttttgagtgtggaagggctgctgaaaggcatcggcagaaaatacgatgactcgaattgcggacagtgtctcgcttgctttacaggaaaatatccgactgaaatttaccaggatacagtgcttcctcacgtaaaagaagcagtattaaccaaataaaacttgaaaaatgacataaaggcagcgcagttcggctgcctttctctttctgccctcattcggggagatattttgaaaagcgccttaaaggagtgaataggatgtctgaagcatataaaaacgcaggagttgacatcgaagccggatatgaagctgtaaaacgaatgaaaaaacacgtggagcgcacgaaacggcttggcgttatgggcagccttggcggttttggcggcatgtttgacctgtctgagctttcttatcaaaaaccagttctcatttcgggaacggacggtgtcggcacaaaattaaagctcgctttttccatggataagcatgacacgattggcgtggacgctgttgcaatgtgtgtcaatgacgtgctggcacaaggtgcagagccgctgtttttcctcgattatttagcggttggcaaagcggacccagtgaaaattgaacagattgtacaaggtgttgcggaaggctgtgagcagtcaggttcagccttagtcggcggtgaaacggctgaaatgccggggctctatacagctgatgaatacgatattgccggtttctcagtcggagtggcagaaaaggacgaaatcgtgactggagaaaacattgaagagggccatctgttgatcggtctcagctccagcggccttcacagcaacggcttttcccttgtcagaaaagtgcttctggatgatgcggagctggacctcgatacaacatatgagccgtttgaacgcccgcttggcgaggaattgcttgaaccgacaaggatttacgtgaagcctgtgcttgccgcggtcaaaagcggaaaaatcgacggcatggcgcacgtgacaggcggaggatttattgaaaatattccgcgtatgcttccggaaggcttaagtgcggaaattgatcatggctcatggccgatcccgccaattttttctttcttgcaagagtacggcaagctaaaggaagaagacatgttcaacgtctttaatatgggtatcggttttgttttggcagtcaaagaagagcatctgacagatgtgatcggaacgcttgaaagccatggcgaaaaagcctatttaattgggcgtgtgaaaaaaggtgaaggcgtcacattcggcggtgcggcactttcatgaaaaagtttgcggtatttgcatcaggaaacggttcaaacttcgaagccatcgtcacgcgtttgaaggaggagaactgggatgcgtcagcagcgctcctcgtttgcgacaaaccgcaggcgaaagtcatcgaacgggcggaagcattccacattccatccttcgcatttgagccgaagtcttatgaaaacaaggctgcatttgaacaagccatcattgaacagcttcgtcttcacgaggttgaattgattgttcttgccggctatatgaggctgatcggtgatacgctccttcaagcatatggaggaaaaatcattaacattcacccgtcgcttcttccggcgtttcctggaatcgacgcagtcggacaggcgttccgggcgggtgtaaaggtggccggaatcaccgtgcattatgtcgatgaaggaatggatacaggtccgatcatcgctcaaaaggctatcgaaattgatgagcatgatacattggaaacaatcgaacagcggattcacaagcttgagcataaatggtatccgagtgtgattaaacagctattaggattaaataacagaggtgaaaaggcatgaccattaaacgtgcattaatcagtgtttcagataaaacaaatctcgttcctttcgtaaaagaactgacagagcttggcgttgaagtcatctccacaggcggaacgaaaaagcttcttcaagaaaacggtgtggatgtgatcggaatttctgaagtgacaggctttcctgaaattatggacggccggttaaaaaccctacacccgaatattcacggcggccttctggcggttcgcggcaatgaagagcatatggcgcagatcaatgaacacgggattcagccgattgacctcgttgtcgtcaacctctatccatttaaagaaacgatttctaaggaagacgtcacatatgaagaagcgatcgaaaatatcgacatcggcggacctggcatgctgcgtgcggcatcaaagaaccatcaggatgtcacggttatcgtcgatccggccgattacagcccagtgctgaatcaaatcaaagaagaaggcagcgtatctcttcagaaaaaacgcgagctcgcggcaaaggtattccgtcatactgcggcatatgatgcactgatcgctgactatctgacaaatgttgtcggtgaaaaagaaccagagcaattcactgtgacatttgagaaaaaacaatcgcttcgctatggagaaaacccgcatcaggaagcaactttctatcaaacagctcttcctgtcaaaggctccattgcgcaagcagaacagcttcacggaaaagagctttcttacaacaacattaaagacgcggatgctgcagttcaaatcgttcgtgaattcactgaaccggctgctgttgctgtgaagcatatgaacccgtgcggcgtgggaacaggaaaaacgatcgcagaagcgtttgacagagcgtttgaagcggataaaacatctatcttcggcggcattatcgcgctgaaccgtgaagtggacaaggcaactgccgaagcgcttcacaacattttcttagaaatcatcattgcgccttcattcagccaagaagcgctcgacgtcctgactgcgaagaaaaatctccgtctgctgacgcttgacgtatccgccgctgttcaaaaggaaaaacagctgacatccgttcaaggcgggctgctgattcaagatttagatatgcacggcttcgatgatgctgagattagcattccgacaaaaagagagccgaacgagcaagagtgggaagacttgaagcttgcttggaaagtcgtgaagcatgtgaaatcaaatgcgattgttctcgcgaaggacaacatgacagtcggcgtgggagcaggccaaatgaaccgcgtcggatcggcaaaaatcgcaatcgagcaagcaggggaaaaagcgaagggcagcgcgctcggttcggatgcatatttcccaatgccagatactgtcgaagaagcggcaaaagcgggcgttacagccatcattcagccaggcggatcgatccgagatgaggattccatcaaaaaagcggatgaatacggcattgccatggtattcaccggcatcagacacttcaaacattaaggggatgaaaacgacgtgaatgtattaattatcggtaaaggcggaagagaacatacgctggcgtggaaggcagcgcaaagcagcctcgtcgagaatgtatttgcagctcctggaaatgacggcatggaagcttccgcacagcttgtaaacattgaggaaagcgaccacgcagggcttgtctcgtttgcaaaagaaaaccaggtcggcctaaccattgtcggccctgaggttcctttgattgaaggtctggtggatgaatttgaaaaagcgggtctgcgcgtgttcggcccgtcaaaagccgcggcgatcatcgaaggaagcaaacagttcgctaaggatttaatgaagaaatacgacattccgaccgcagaatacgacacgtttacatcctttgatgaggcgaaggcatatgtgcaggaaaaaggtgctccgattgtgataaaagcagatggacttgcagctggaaaaggcgttactgtggctatgacagaggaagaagcaattgcatgtctgcatgactttcttgaagatgaaaagttcggtgatgcgagcgcgtccgttgtcattgaagaatatctttctggtgaagaattttctctgatggcctttgtcaaaggggaaaaggtgtatccgatggtgattgcccaggatcacaagcgtgcgtttgacggagacaaaggtccgaatacaggcggaatgggcgcttactctccagttccgcaaatttcggaagaaacggttcgccatgctgtagaaaccatcgtgaagccggccgcaaaagcaatggtacaagaaggccgttccttcactggcgttttgtacgctggattgatgcttactgaaaacggctcgaaggtcattgaatttaatgcccgtttcggcgatccggaaacacaggtcgtgcttccgcgcatggaatctgatctggtacaggtgcttcttgatcttttagatgataaggaagttgacttaagatggaaggataccgcggcagtgagtgttgtgcttgcatcagaagggtatccggaaagctatgcaaaaggcacgccgatcggcagccttgcagcagaaactgagcaggtcgtggtcttccatgccggaacgaaagcagaagatggagagttcgttacaaacggggggcgcgtcgccaatgtgacggcttttgatgaaacgtttgaagcggctagagaccgagtgtacaaagcggttgatgaaatattcaaaccgggactctttttcagaaaagacattggggcacgcgctttaaaggctgcccaaaaataagtgaggaaaacccgcagaatagctgcgggttttttgttatcaaaaagcgggatggcagctggaagaagaaaggacaacgagcgtggttggttttccatgggccatcgaggcgtcaataaaatcctcaagcgtatgtaccgattcagtcacgacctttgtcacatagctgtacatccctgtgatgcggtggttttctgctacatcagggtgcgcttttgcaaaggcggcgtagtgcttgcagcttttcggctccatgagaatgaaagcggtgacatgcttgtttagtttttcataacagatattcgcgctgtacccggtaatcactcctttgtcttcaagcttcctgacacgctccgccgcgcttggcgaactgagtccgacaagctttcccagctcaaccatcgttaatctgccgtttcgctgcaaatgcgagagaatctgaaggtctgtatcgtccatttgtccggctcctttacatatttaggcgaatgaatgaaaattcctttgatcgtaaggtaatgctgttgatttaacttcattgtagcatatggatgccgtcttattttttctataataaagccatcaatcagagaggaggcatcatgttgccagaattacagcgctctattacttggatacaagggacggcgttaacgattggggcggttttaggatgcgggatattaatcctgccgtctgtcactgcggatacggccggtccggcttctttatttgtctgggtattcatgtcttttttatcttttcttctcgtcggcacgctggcacggcttgtgaaaattgcgcccagcgcgggaggaatcactgcttatgtgcagctggcctttcagaaaaaagccggggctattttgggctggatcatgttaggttccgttccgattggcgttcccatcatcgctttgactggcgcgcattacgtcagttacatcacagaggcggccgattggcagattacattgattgctggttgcatgctggctatatctattttgcttcatatgagaggcattcaactatcagcaaacatcagtacaatcgttatttgtgtcatcgtatttctgcttgtcacttctattgctgtgtcattgccacacgtcacgatagcagaattcaagccgtttcttccgcatggctggtctgccgctggatctgtttcagttatgatttttttctcttttgtaggctgggaaatgattaccccgttggctgaggaatttcatcgccctgaaaaagatgtcccgctcagcttgtttttggcagcgtcttgtgtggcagggctgtatatcatgctgtcatttgtgacggtggggactcattcatatggagagaatggagaaattgcatcgcttgccatgctcatttcaaaaggagcaggggaaagcggtgtatacgtcacggtatgtttagcgctgtttattacattcgctaccatccatgccaatattgctggtttttcaagaatggtgtacgcattggcgagagaggggcacatacccgtattttttggaaaactcagtgcgacaaaacgtacgcctatccgtgttttgacagcgatggccgcagtgtttggcttagtgcttgcggcgcatggtctgtttcaaatcgatttgacgactctgttgaaagggccgagcgcggcttttatcgcatcttacatatgtacaatggcggcagcactgaaactgctgggcaggagagatataggctggtggatggcgctcggggcatttgcggcgtgcgcggtgatttattcattcagcggctgggcactgctttatccggcagtgctggcagctgcaggatatttctatatgaaaacaaaggatgggcataaaaaaaagcttgatcacgttttgtgattaagcttttccatttatccgttttgatgctcgttatttccagaatcactgtgttgaaacatgtaggtcacaggacagaagcgcaagattcccgaacccgctttcatggcccccataaagatgtaaaagagatgcattctgcaccaaggttttttcgtaaactttgcactggcggctgacataatcgtcaatccgcaggcgattctgaacacggcattgatgagactgatgtttggcttcaaggaaatccgctccttttacttaaaaaagttttttaaccgaaccttcaaaaatttgtaacgtttttatcgtgcgtgatgaggaaggatgtgataccatgagtctaatacatgtaaaggagagtatgtgaatgtccgaacgcacctttaactggaaaaacaaagacatcagggcacaggttgatgttgtagactcaaagctgcttccaacgctccttttacggaatgctctcgtcttaaatccatatgtaaaacaatggctgaaaaaaaacatttggatttatcaggaccgcattgtttatgtgggtcatgaacttccgaatagagccgaagaaattcatacgattgattgtgaaggaaaatacattgtgccaggttatattgaaccgcacgcacatccttttcaaatatataatccccaaacactggcggaatatgtgtctcaatacggaacaacaacattcgtgaatgataacttatttttgcttttgcaaagcggaaaaaagaaagcgcttacgattttgaatgaactcaaaaagcagcctgtccagtatttttggtggtcacgctatgacctccagaccgaggttctgaacgaggaccacgtccttccatttgacgtcagaaaacagtggattgaacatccggatgtgattcaaggcggagaaatgaccggatggcctcgcctggtagatggtgatgatttaatgctccactgcatgcaagctacaaagaaacagagaaaacgcattgaagggcattttcccggcgcttctgataaaacgcttacaaaaatgaagctgttcggtgcagattgtgatcatgaagcgatgtcaggtgatgaagtgatgagaaggctggaactgggctattatgtttcccttcggaactcttccattcgccctgatgtaagaaaaatcttgcaagagctgcatgagaagggcttccgctattatgaccacttcttttacacgacagatggcgcaaccccgaatttctataaaggcggcatgacaaacgagctgattcgcatcgcgttagaagaaggcgtacctgcaatcgacgcctacaatatggcatcatttaatatcgcaaagtattaccaaatggatgattatttaggagttgtcggaccgggtagactggcatcgctcaacatactggaagatccgttaaatccgaatcccgtgactgttctgtcaaaagggactattctgcgtgaagacggctgtgatttgaaggcgtttacaaaggcggactggcacaaaggtggtcttgtcccgcttgagctttcatatgatatgacgatggatgacttgcagttttctatgccgatgggcgtgaaaatgcggaatgcggttattatggagccgtatatgattgagattgacaattcgatggaacagctctcgtttgaccatgatgaaagttatttgacgatgctcgacagacacgggaaatggcgcgtcaatacgatgataaaagggtttgcctcaagcgtgcagggatttgtaagctcctttacgacgacgggcgacattgtcgcgattggaaaaaataaagcggatatgctgctcgctttcgcccggatgaaagaaatcggaggaggaattgttttagcggagaacggaaacattttgcatgaaatcccgcttgccctgtgcggctgcgcctcttcggaagcgtatgaagaagtgcttgagaaggaacaaaagctgagagatcttttgactgaaagaggctatgagttttgcgatcctatctatacgctgctctttttgcaaagtacgcaccttccgtatatacgcattacgccaagaggaatcttcgacgtcatgaaaaaaactgtactctttccatcgataatgcgttaaaatataaaagagcagggagccgacatatgaaaaaatggatgacagtttgcgcgctgtgtttcgtgttttttctgctggtatcctgccagcagaaggatgctgtcccggatactgcaaagaagctgaaagctcctttaacggggctaaagactgaacagaaagtgactgaacgccgccctgttgctgttgtggtgaacaatcacccgaaggcgaggccgcagtcgggtctgtctaaagccgacattgtcatagaagcgctagccgaagggcaaatcacaagatttctggccattttccaaagccagatgcctgaaactgtcggacctgtgcggagcgcgcgggaatatttcgtcactctcagcaatggctttgacagcatatttgtccatcacggctggagtcccggcgccaaaaagcagctggaatccggagctgccgattatatgaacggattggattttgacggaagcttattttggagagctgatttcagcaaaccgccccacaattcctatacgtcttatgattacataaaaaaggcggcagaacaaaagggttataagctgaagcaggaaacaaatccgctgctgtttcaaacatcagatgcaaaacctgcaaatgaatcttacaatgttcgggtagattatggaacaaaaaacgttacaaatcttgtcgaatacaactatgataaaaaagctgaatcttatacaagaagctctgatggtgtcataacgacagaccgggaaaccggaaagccggttgcaatgcaaaatattttcattgttgaagccagccatcatattattgatcaagatggaaggcgggacatcgacttggtatcaggaggaaaaggtctgttgtttcagcacggaaacgtcattgaaacagactggaaacaagtgaatggcagaattgtgccgataaaagacggcaagtggcttccgtttgtgccaggaaagacttggatcaatatcgtacctgatcttgatgcggcttccattagtaaaggagaaggtgtgtaacgatgcaaatcgataaattacgcggcaaagagctggaccagttatttaactcgatcttatcgctgaaagacctggaggaatgttaccgattcttcgatgatctatgcacaattaacgaaattcaatcgctggctcagcgccttgaagtggcgcgcatgcttcgcgaaggaaacacgtatcataagattgaaacagaaacaggcgcttccacggctacgatttcccgtgtgaaacgctgcttaaattacgggaatgacgcttatgaaatggcgcttgaccgtgtgaaggagacggaaactgagtcttcttcaaaataataaacaaccgccctgccgttcggcaagggcggtttctttatgaaacaaattgatggatcaggttgtcgatatcgatgatactgccatcctctttccgatagacaacatgctccttggaaaagtgaatcggcgaattgatccctgctgcggctgcaaggttaaatagtccctcgcgcaatgaaataacgtagttgcagacacgatgctgtttttcctcaacgctcagtgctttttgcaatttcggatctgtcgtcgccacacctgccggacatttgttggtgtggcagacgagagcgcggatgcagccaacggaaaacatcatgccgcgtgcgatgttgacaaagtcagcgccgagggctaaggcgaccgcgattttatcaggagtcaggagctttccggaagcaaagattttcagctggctgcgcaagccgtactgtttaagaagcgtgtcaacaataggcagcgctgtcataatcggaaggccgactgtatccgcgagctcgtaaaaggaagctccggtaccgccttcacttccatcgatcgtgataaaatccggatgttttccgcttttctgcatatgagagaaaagctcatgcaattcttcaggatgccctgcgaccagtttgatgccgactggcttttgtccgacatctctaagtttttcaataaagtcgagcatttcaggagggtttgagaattcataaaagcggttcgggctgtcaatcgactttccaggttcgacattccgaatgtctgccacttcctctgatactttggcgccatccacatggccgccccgggttttcgctccttgtgccagctttagctcaaacgctttaatctggtcaatcctgctttttcttttaaattcctcccacgaaaattccccgtttcttttgcgcacgccgaataggcccggtccgatttggcaaatgatatcggcgccgccctttaagtgatattcagacaatcccccttcacctgtattcatccaggtgccgcctgcctgatggagcccttttgagagcgccgtaacagcccgttctccaagagaaccgtagctcatggcagactggccgactaagcccttcacataaaatggcttctcgcatgtacgctcgccaatcacctgtacatcatcaggatggagaaaatacgggtctgccttgatatgttcggcatgctccttgcgtttgaacagattgtcagcatccattttatagatttgggtttcaattttgggcgtttgatttacgtgcatttcttccctttgttttggaaacatagcgttacggatataatagccaggtttatcaaaatctcttacagatccaaagcccatcattctgcttttgtatttgccggagatgacggtttgctcatattcctttcgtgaaaaaggctgctcctcattgtcattgctgtataaatactgtctgagctccggcccgattttttcaaggatataccgaaaccttccgatgacgggatagttgcgaagaattgagtgctcctgctgtttttcatcctttatgtagatccaggcaaacaagacgatcgggatagcgatgatccctatgataaatgcgatgagtgctattatgatggtttccatctctcagcctccctttttatgtaaccatttccacagttgaacactttccaaacaatagcagaaggaatctggtgaaaaatgtgtgcttctgccgatacaggactcagagagcaggtactgccatatgctctttttttatgaaaatagaatcaaaacacctttttcagtgaataacgagattaacggctttttccgtttttccgcgctatgtgaatttgttataatgtttaaatggtaacaaacgaatggaggaacgtatgacgtgtacgatgtaacggagtggaagcatgtctttaaactcgatccaaataaagatttgcctgacgaacagctggagattctttgcgaatcaggaacggatgcggtcattatcggaggcagtgatggtgtaacagaggataatgtcctgcggatgatgtctaaggtaagacggtttttggtgccgtgtgtccttgaggtatcagcgattgaagcgatcgttcccggctttgacttatattttattccgagtgtattaaacagcaaaaacgcggattggattgtcggaatgcaccagaaagccatgaaggaatacggagaactgatgtctatggaagaaatcgtggcggagggctactgcatcgcaaatccagattgcaaagccgcggcactgactgaagcggacgccgatctgaatatggatgatattgtcgcctatgcgcgtgtgtcggagctgctgcaactgccgattttttatttagaatacagcggcatgcttggagacatagaagctgtcaagaaaacgaaggctgtattggaaacgtcaaccttgttttatgggggcggcatcaaggatgcggaaacggccaagcagtacgcagagcatgcggacgtgatcgttgtaggcaatgctgtgtatgaagattttgacagggctttgaaaacagtagcggctgtgaaaggcgagtagtaaattgtacggatttggtttatgatagaacatatgttttgtataggcgggtgaacaaattttgaattatattagcaatcaattactaagcggtttaaaccccgttcagcaggaagcagtcaaaacaacggacgggcctcttttgctgatggcgggagcgggaagcggaaagacgcgtgtcctgacccatagaattgcttatttaatggcggaaaagcatgtggcgccgtggaacattctggcgatcacatttacaaataaagcggcacgcgaaatgaaagaacgtgtggaaagcatcctcggacccggcgcggacgatatctggatttccacattccacagcatgtgcgtgcggatcttgcgcagagatatcgaccggattgggatcaaccgaaatttctccatccttgatacggctgaccagctttcagtgatcaaggggattttgaaggagcgcaatcttgatccgaagaagtttgacccgagaagcatcctcggtacgatcagcagtgcgaaaaacgaattgaccgaaccggaggaattctctaaagttgctggcggctactacgatcaggtggtcagcgatgtatatgctgattatcagaagaagctattgaaaaaccagtcgctcgatttcgacgatttgattatgacgacgattaaactgtttgaccgagtgccggaagtacttgaattttatcagcgcaaattccaatacatccatgttgatgagtatcaggatacgaacagggcgcaatacatgcttgttaagcagcttgccgagcgtttccagaacctttgcgttgtgggggattctgatcagtcaatctacagatggcgcggcgcggatatcaccaacatcctttcatttgaaaaagattatccgaatgcaagcgtgattttgctagaacaaaactatcgttcaacgaaacggattttgcgcgcggcaaacgaggtcattaaaaacaactctaaccgcaaaccgaaaaatttgtggacggaaaacgatgaaggcatcaaaatttcctattatcgcggtgataatgaattcggagaaggacagtttgtggccggcaaaattcatcagcttcacagctcaggcaagcggaaactgtctgatatcgccatattataccggacaaacgcgcagtcccgtgtgattgaggaaacgcttctcaaagcgggcttgaactataacattgtcggcggcacaaagttctatgacagaaaagaaattaaagacattcttgcgtacctgcgcctcgtatccaatccggatgacgatatcagtttcacgcgcattgtcaatgtgccgaagcgcggagtcggcgcgacatcacttgaaaaaatcgcttcgtatgcggccataaacggcttgtcatttttccaagcgattcagcaggttgattttatcggcgtcagtgccaaagcggcaaacgcgcttgacagctttagacagatgattgaaaacctgaccaatatgcaggattacttatccattacagagctgacagaagaaattcttgataagacggaatacagagaaatgctgaaggctgagaaatcgatcgaagcccaaagccgtttagaaaatatcgacgagttcctgtctgttacgaaaaactttgaacagaaaagtgaagacaagacactcgttgcgttcctgacagacttggcgttgatcgcagatattgatcagctcgatcagcaggaggaagagtcaggcggcaaggatgcgatcaccctgatgacactgcacgccgcgaaaggactggagtttccggttgttttcttgatggggcttgaagaaggcgtcttcccgcatagccgttcactcatggaggaagcggaaatggaagaagaacgccgccttgcgtacgttgggattacaagggcggaacaggagctttatctgaccaatgctaaaatgcgcaccttgtttggccggacaaatatgaacccggaatctcgcttcattgctgaaataccggatgatttattggaaaacctaaatgagaaaaaagaaacgagagcgacgtctgcgagaaaaatgcagccgagacgcggccctgtttcacgcccggtatcctacgccagcaaaacaggcggcgacaccttaaactgggcagtcggagataaggcgggccataaaaaatggggaacaggaactgtcgtcagcgtgaaaggcgaaggagaagggacggagctcgatattgcctttccgagccctgtcggcgtgaaacgcctgttagcagcatttgctcctattgaaaagcagtaattgaagaggaaaggaagaagcagatggacaaagaaacagcgaagcagcgggcagaagaactgcgccgcaccatcaacaagtatagctatgaatattacaccttagatgaaccgagcgtcccagatgccgaatacgacagattgatgcaggagctgattgcgatcgaggaggagcacccagacctcagaacgcctgactctcctacgcagcgcgtcggcggagccgtgcttgaagcgtttcaaaaagtcacccacggcacaccgatgctcagtctgggcaacgcctttaatgctgatgatcttcgtgatttcgaccgccgtgtgcgccaagccgtcggcgacgatgtggcgtataatgtggagctgaaaatagacggtcttgctgtttctctccgttatgaagacggctattttgtcagaggggccacaagaggtgacggaacgactggagaggatattacggagaacctgaagacgatccgcaatatcccccttaaaatgaaccgtgagctgtcaatcgaagtgcgcggagaggcgtatatgccgaaacgttcgtttgaagcactcaatgaggaacggattaaaaatgaggaagaaccgttcgccaatccgcgaaatgccgcggcgggatctctcaggcagctcgatccgaaaattgcagcgaaacgaaacctcgatatcttcgtctacagtatagcggagcttgacgagatgggtgtggagacgcaaagccaagggcttgattttctcgacgaactcggatttaaaacgaatcaggaacgaaaaaaatgcggcagcatagaagaagtcatagtgctgatcgatgagtttcaggcgaagcgcgcagacctgccgtatgaaatagacggcattgtcattaaagtcgattctctcgatcagcaggaggagctcggttttacggcgaaaagcccgcgctgggccatcgcgtataagtttcctgctgaagaggtcgtgacgaagcttctcgatatcgaattaaatgtcggcagaacgggtgtgatcacgccgaccgcgattcttgagccggtaaaagttgccggcacaacggtctcaagagcatcccttcataacgaagatttaattaaagagaaggacattcggattttggataaggttgtcgtcaaaaaagcgggcgatatcatcccggaagttgtgaatgtcctcgttgaacagcgaacaggagaagaaaaggaattcagcatgccgacggaatgtcctgaatgcggcagtgagctcgtccggatcgaaggagaagtggcgcttcgctgcattaaccctgaatgtccggcgcaaatccgggaagggctgatccatttcgtttcccgcaatgccatgaacattgacgggctcggcgaacgagtgatcacacagctgtttgaggaaaaccttgtccgcaatgtggcagatttatataagctgacgaaggaacgagtcatccagctcgagcgcatgggtgaaaagtccactgaaaacctgatcagctccatccaaaaatcaaaagaaaattcgttagagcgtttgctgtttgggcttggtatccgttttatcggatcaaaggctgcaaagacgcttgccatgcattttgaaagcttggagaacctgaaaaaagcctcaaaagaggaacttctcgcggtagatgaaatcggtgaaaaaatggctgacgcggtcatcacctattttcataaagaagaaatgcttgaactcttgaatgaacttcaggagctgggcgtaaacacgctctacaaaggcccgaaaaaagtaaaagcagaggacagcgactcttactttgccggtaaaacaattgttctgacaggaaagctggaagagctgtcaagaaacgaagccaaagcgcaaatcgaagcgctgggcggaaagctgactggaagcgtcagcaaaaacacagacttagtcatcgccggagaagcggcgggaagcaagctgacaaaagcacaagagctgaacattgaagtgtggaatgaagaacagttaatgggagagctaaagaaataagaggagtgttttctattgaaaaagacgttggcattggcggcaacggcggcagtattaatgctgtctgcctgctcgtcaggttttgggggggagaaggaggaagagattacgcaaaagacggcgaaatcgtcagaaaaagcgattgtcccgaaatataatatctctgactcctattacaaaatggtgctgccgtttaaggcaggcaaagcgcgcggcttaacaacggaacagctgaacactaggctggacattgacgagtttgaaacagggctgatgcgtcttgcccaagattctttctcgactgacgattatctgttccaagaaggacaatatttagatgaggatacagtattaagctggctggcacggaaaaaaacgggctctgatttgaaaaaagccgaaaaagaagataaaaacttcaaaaatgaaggcttgaacccggcgctcccgagttctggttcaacagaagaaaagaacgaaagcagcccgatttatttagcatccatgcttgagcacgattatttagtcagaaaagacaagaattctatccagcttggcggcgtcatgatcggactggcgttaaactcagtgtattactatcgtgaaaaaactggcgacccgcaaaaagaagtggagattaaagacagcacgcttcgccagcagggagaaaaaattgcacaggaggttattaaccgcctccgcaaaaaagataacttgaagaatgtgccgattaccgtcgcgctctacaagcaggcgtcaaaaacatcgattgtgccggggaacttcatcgccaaaacagaggtcaaagcaggctctactgatatctcaaattgggatgacatcaatgaaaaatatgtattctatccggcagatacaaccacagcagaaaaatacccggatgacaccgaggtctttaagcggttcaaaaactcaattgaagaatatttcccgaactatacaggcgttgtcggtacagcgctgtatgaaaatgatgaaatgaagaaaatgaagattgacataccaatgcaattctacggaaaaagtgaagttgtcgcgtttacccagttcttaacgggtgaagtgatggactactactctaagagctcagttgatgtcgaagtcaatatcacgtcctcagacggacaggaagcggtcattatccgcaatgccggagataaagagccgactgttcacatttatgactgatagaaaacccttgtgccatattggcacaaggggttttatgttacaattaacaggaaaagggaaaatatttccgcttctgccgaaacacaaatcaaggggaggtatgttgatgctggaaatcgtgtgaaaacaatcattatcaaatctatagcaatgaaaggatgttagacatgcataaagatatcaaaaaaatatttgaggaagagcaggttttggcagaagctgcagcgagatacggtttctcaaaagatcaggtgcgttttctggctgatgcggaaaactatgtatatgaatgtatgaaagacaatcaaccttatattttaaagattacccatacgattcggagatcttctgattatataatgggagagatggaatggctccgtcaccttgcaataggaggaatttcagtagccaaaccgctcccgtcgctgaacggaaaagatgtagaagcagtgccggacggaaacggcgggtcatttttattgagagtgtatgagaaagcgccggggcaaaaagtggatgaatcggactggaatgaaacgctattttatgagcttggcagatacacaggcagcatgcacagcttgacaaaaagctacaaattgagcaatcccgctttcaaaagacaggaatgggatgaagaggagcaattaaagctgagaaaatatgtacctgaagatcagataaaggtgtttcagcaagccgattatttgatgaatgaactgcggaggctcccgaaaagccaggacagctacggcttggtgcatgcggatctgcaccatggcaattttaactgggatcatggcaaaatcacggcatttgattttgatgatatcggctacaactggtttgttaacgatattagcattcttctctacaatgtcctgtggtatcctgttgtgccatatgatgataaagctgcgtttacagaagaatttatgacgcattttatgaaagggtactgggaggaaaatgagcttgaccctacatggctgatgataatacctgatttcctccgccttcgccatatgctgatttacggattgctgcatcagatgtttgaccttaacacaataggagaagaggaaaaagaaatgctggccggtttcagaagagatatagagaatggcacgccgattacagcatttgatttttcagcactggtgtagatagaaaaagccaatgggattccagtcccattggcttttataatgtatcacacttcacgccgactacgccttcaatggctttaatgtcatagtagacatcggtcgtgtatctgtttttatggacgcggaccttcacttccataattggaaaatccttttcgcctaggtcgtcgatccgaacggagtgtgctttgatatctcttcttttcatttcttttaaaatctctgtcattttgtctttatcagaaagtgacattctgatgcggatgtctttttcctgcaggcggtcggggccgatttttctgaccacccatgggagaaattccacgctgatcaggatgaacagaagactggcaaacgcttctttataaaaaccggctcccgtagccagcccgagccccgctgccccccagatcatggccgatgtcgtcaggccggaaatgacatcattgctttttcgcaggatgacaccggctccgataaacccgacgccggagatgatttgtgccggcagacgaagcggatccatcatgatgcggtagtatttagggaaatgatatgccgcattaatactgacgatcgtcagcatgcatgagctgactgcgatgacgatacaggtttttaatccgagcggcttattttttaattcgcgttcaagcccgatgaccatgccaatcaatgtggcaatgcccaatttcaataaaatatcaggatcaatataccagctcaacagcaacttcccccttctctaaggtgtttttaaataaatatgattttctcacagtatttatagcaaaacaagggtacaaaagccaccaagctgcgcttgatggcttattgcttactttttgcgttttaacagcttttccatgacaccgaataatcggtaagaggcttttgcaggacgttttgtgatcatgctgacaatgatgccggcaatcatactgagaataaacccagggatgatttcgtacacaccggttgattttgccaggccggttgtaatccagatcaacacggtcgcagccccgacaatcatggcagcaagcgcgccccattcgttcattcgcttccaatacagactgagcagaatcgcaggtccgaaagctgaaccgaagccggcccaagcgtatccgaccaaatcaagaatggtgctgttcgggttcaatgacaagagtaccgcgataacggcaatgactaagacggacaatcgcccgatcatgaccaattctttatcagaagcttttcgtctgaaaaatgaccggtataaatcctctgttacagcacttgctgtgactaagagctgtgaggaaatcgaactcatgatggcagccaaaatagctgacaataagaaccctgtaattaatgggtggaacaagattttagagaagataatgaaaatcatctccggatcttttacagcaactccgaatttatgggcgtatgcaacaccgattaaacccgtcagcacggaacctagaactgtaatgatcatccagctcataccgattcggcgtgcaggttttaaatctttaatgtctttaatggccataaatcggacgatgatatgaggctggccgtagtagcccaacccccaggctaaataggaaataatgctaatgacgctcgcgcctttaaaaatatccaataagtgtgggttaacagcgtcgatttcatggaaagtcggagcaacgccgcccacatgggtaaaagcaacgatcggcacaagcactagtgctgcaaacatgatcgcaccctgcacgaagtcagtcagactgacagcaaggaaaccgccaaacagtgtgtataatacgacaactgcggtggtcagaaacaagcctaatttgtaatccgcaccaaaagcagattcaaacagccgtccgccagataccataccggaagaggtatacaatgtgaaaaagatcatgatgatcaatgcagatacgattttcagcagtgatgaagaatgctggaatcgtttatcaaagaaatcaggaatcgtaatcgcatcatccgccgcttctgtataagcacgcagccttggagccagcagcaagtaatttgagtacgccccgattgtaagacctaaagcaagccataaggtggacagccctgtcgcaaacatcgcgccgggaacacccatcagcatccatccgctcatatcggccgcgccggcagacaaagcagtaacgaatggtccgaggcctcttcctccaagcatgtaatcattgatgtcagtggttttcttgaatgcataccagccgattaacagcatggcaataaagtaaattcctaaagatataataatttcaatactcacgttttaccctctcttcatttctaataatgttgcatcacctctcaaattgatggtgccagttaagcagcctggcgtaagtgcaaaacaaaagaaattcctttgcgggtgcacttggtaacttaacctaacaaagtattcccggccattcaagcgatgaaaccttgatcatgagcggggaaaaccgttgcaaacctagaagggaataaagaataaaacgctttcaagaaataattaaagtaaaaatattcagaaaaatatttcgtttctccttctcctcattttagtataaaatatatagggtattgtttcgaaaacacaggcctgtctcaaggcgttttgttgctttaaagggcttgtttttgatatgatcagtattatatgacttaacggagaaatatgtggaggtggatcatatgtcacgaatttcaatagaagaagtaaagcacgttgcgcaccttgcaagacttgcaattactgaagaagaagcaaaaatgttcactgaacagctcgacagtatcatttcatttgccgaggagcttaatgaggttaacacagacaatgtggagcctacaactcacgtgctgaaaatgaaaaatgtcatgagagaagatgaagcgggtaaaggtcttccggttgaggatgtcatgaaaaatgcgcctgaccataaagacggctatattcgtgtgccatcaattctggactaaaggagggacacaagaatgtcattatttgatcataaaatcacagaattaaaacagctcatacataaaaaagagattaagatttctgatctggttgacgaatcttataaacgcatccaagcggttgatgataaggtacaagcctttttggcattagatgaagaaagagcgcgcgcatacgcgaaggagcttgatgaggcggttgacgggcgttctgagcacggtcttcttttcggtatgccgatcggcgtaaaagataatatcgtaacaaaagggctgcgcacaacatgctccagcaaaattctcgaaaactttgatccgatctatgacgctactgtcgttcagcgccttcaagacgctgaagcggtcacaatcggaaaactgaacatggacgaattcgccatgggatcatctaccgaaaactcagcttacaagctgacgaaaaacccttggaacttagaaacagttcccggcggttcaagcggcggatctgcggctgcggttgctgcgggagaagttccgttttctcttggatctgacacaggcggctccatccgtcagccggcatctttctgcggcgttgtcggattaaaacctacatacggacgtgtatctcgttacggtctggtcgcatttgcgtcttcattagaccaaatcgggccgattacacgtacggttgaggataacgcgtttttacttcaagcgatttccggcgtagacaaaatggactccacgagtgcaaatgtggacgtgcctgattttctttcttcattaactggcgacatcaaaggactgaaaatcgccgttccgaaagaataccttggtgaaggtgtcggcaaagaagcgagagaatctgtcctggcagcgctgaaagtccttgaaggtctcggcgctacatgggaagaagtgtctcttccgcacagtaaatacgcgcttgcgacatattacctgctgtcatcttctgaagcgtcagcgaaccttgcacgctttgacggcatccgttacggctaccgcacagacaacgcggataacctgatcgacctttacaagcaaacgcgcgctgaaggtttcggaaatgaagtcaaacgccgcatcatgctcggaacgtttgctttaagctcaggctactacgatgcgtactacaaaaaagcgcaaaaagtgcgtacgttgattaagaaggatttcgaggacgtatttgaaaaatatgatgttattgttggaccgactacaccgacacctgcgtttaaaatcggtgaaaacacgaaggatccgctcacaatgtacgcaaacgatatcttaacgattccggtcaaccttgccggcgtaccgggaatcagcgtgccatgcggattagcagacggacttccgctcggcctgcaaatcatcggaaaacactttgatgaaagcactgtataccgcgttgctcatgcatttgaacaagcgacagaccatcataaagcaaaacctgaactgtaaggggtgaaaagaattgaactttgaaacggtaatcggacttgaagtccacgttgagttaaaaacaaaatcaaaaattttctcaagctctccaacgccattcggcgcggaggcgaatacgcagacaagcgttattgacctcggatatccgggcgtcctgcctgttctgaacaaagaagccgttgaattcgcaatgaaagccgctatggcgctcaactgtgagatcgcaacggatacgaagtttgaccgcaaaaactatttctatcctgacaacccgaaagcgtatcagatttctcaatttgataagccaatcggcgaaaacggctggatcgaaattgaagtcggcggaaaaacaaaacgcatcggcatcacgcgccttcaccttgaagaagatgccggaaaactgacacacacaggcgacggctattctcttgttgacttcaaccgccaaggaacgccgcttgttgagatcgtatcagagccggatatccgcacgccggaagaagcgtacgcgtatcttgaaaagctgaaatccatcatccagtatacaggcgtttctgactgtaaaatggaagaaggctcacttcgctgtgacgccaatatctctcttcgtccgatcggccaagaggaattcggcacaaaaacagaattaaaaaacttgaactcctttgcgtttgttcaaaaaggccttgagcatgaagaaaaacgccaggagcaggttcttctttccggcggcgtcatccagcaagaaactcgccgttatgatgaagcaacgaagaaaaccattcttatgcgtgtcaaagagggatctgacgactaccgttacttcccagagccggatctagtcgagctctacattgatgatgaatggaaggaacgcgtaaaagcaagcattcctgagcttccggatgagcgccgcaagcgttatatcgaagagcttggcttgcctgcatatgacgcgatggttctgacgctgacaaaagaaatggctgatttcttcgaagaaaccgttcaaaaaggcgctgaagccaaacaagcgtctaactggctgatgggtgaagtgtcagcttacctaaacgctgagcaaaaagagcttgccgatgttgccctgacacctgaaggccttgccggcatgatcaaattgattgaaaaaggaaccatttcttctaagatcgcgaagaaagtgtttaaagaattgattgaaaaaggcggcgacgctgagaagattgtgaaagagaaaggccttgttcagatttctgacgaaggcgtgcttctgaagcttgtcactgaggcgcttgacaacaatcctcaatcaatcgaagactttaaaaacggaaaagaccgcgcgatcggcttcctagtcggacagattatgaaagcgtccaaaggacaagccaacccgccgatggtcaacaaaattctgcttgaagaaattaaaaaacgctaataaaaaagcagcccttagaggctgctttttttatggtcaaattgagataaagacagagatgagggcccgaagcctttcaacttctttgtcgttggttccggtcaaattggacagcatgcctttaataatcggcttgcgcggtttatcctgagtcaattcttcctcgataacatcaagtgacacggtgatatcctcgggcagcgtgctgttttctttcactttctgaatgtcctcaagcagctggtcttttcccgcaggcatcgggttgaaaatgtcttttgatacaatcggattgagtgcagaacggctcagcccctgtacaagatcattcagtctctcaataataaaggctgagatttcttctgcatcgatattaagctcaccgttaaataccatcacgttcatataggaatgcacaatgcctcttgccatgatggacagatctgcgacataccgctcgattccttcgccataggataccagcaaggcgttccggtacagcttatccgtctccatggttactttgtaaaagtattgcttgatttcttgattttccggaatgatattttcggtaagcaaaagaacgataaaatctttatgatcgcgaaaatcctcaaattgagcgccaatttgcttttttaacacttccttagggggctttccggcgagatcttcttctatatttttcattttgttcatagacataccgatataatattcacaggcagataacagcagcgcttctttcgatttgaagtgcaaataaaaagcgcccttcgaaatgccgcattcactggcgatttcttggatcgtcgtagctgcgaatccttttttcgcaaataaacgaatgctggtttttatgattctctcttttttttcattcatgacgtgcttccccttaatccttgaaaaatttagtaaaattttctggtatatgagttgacgttgttgcgttataacgtttagtattatatagaatgaccagtcagtcaataaaaaatgtaatggaggatatgatgaaccacgttattaatttcgttctgaaaaacaaattcgccgtatggctgatgacgattattgtaacggcagccggcttgtatgcgggtatgaatatgaagcaagagtctattcctgacgtgaacatgccttacttgacgatcagcacgacatatccgggtgcaacaccaagccaagtggctgatgaagtgaccaaaccggttgaacaagccgtacagaacttggacggtgtcagcgttgtgacgtcgacgtcctatgaaaacgcatcgtcggtcatgattgaatatgattatgagaaagatatggacaaagcgaaaacagaagcagctgaagcgttagaaaacgtcaacctgcctgatgacgcgaaggatccggagatttcacgctacagcttgaactcattcccgattctgacgctgagcgtgtccagtgataaagataatctacaagagctgacgaaacaagtggaggacagcctcgtttctaaacttgaaggcatagaaggcgttgcgtccgtccaagtatcaggccagcaggtggaagaggttgaattctctttcaaagaagacaaactgaaggaatacggccttgatgaagatacagtcaagcaagtgattcaaggttcagatgtgacaactccgcttggattgtacacattcggaaatgaagaaaaatctgtcgtcgtcagcggcgatattgaaacaattaaagatttgaagaatatgagaatcccgacggtatctgcttcaagtgcaggcagcagcgcagcatctcaagcgggtgcgcagagtgctcaagcagcccaaagcgcacaagcggcagcacaggcgcagcaaagcgcaagcacagcagtgccgacagtcaagctttctgacattgctacaattaaagatgtgaaaaaagctgaatctgtttcacgcacaaatggcaaagacagcatcggcatcaatatcgtcaaagcaaacgatgcgaatacggtagaggttgccgacaatgtcaaagctgagctgaagaagttcaaagaagaccataaaggcttcaattacagcgcaactctcgacatggcggagccgatcacacagtcagttgacacgatgttaagcaaagccatcttcggtgctatttttgcgattgtgattattctcttattcttaagagatatcaaatcaacattaatttctgttgtttcaattccattatcattgctgatcgcactccttgtgctgcagcagcttgatatcacattgaatattatgacgctcggcgcaatgaccgttgccatcggacgtgtagtcgatgactccatcgttgtgatcgagaacatttaccgccgcatgagactcaaagatgagccgctccgcggaaaagccttggttcgtgaagcgacgaaggaaatgtttaaaccgatcatgtcatcgacgattgtgacaattgcggtattcctgccgctcgcacttgtaggcggacaaatcggtgagttgtttattccgtttgccttaacgattgtttttgcgcttgccgcatccctggtgatttcgatcacgcttgtgccgatgctcgcacacagcctgttcaaaaaatcattaaccggtgcgccgattaaagcgaaagaacacaaaccaggcagacttgcaaacatctataaaaaagtattgaactgggcgcttagccacaaatggatcacgtctatcatcgctgttctgatgctccttggaagcttgttcctcgtaccgttaatcggtgccagctacctgccgtctgaggaagaaaaaacgatgcagctcacatacagcccagaaccgggtgaaacgaaaaaagaagccgaaaatgaagctgaaaaagcggaaaaaatcctgcttgaccgcaagcatgtcgatacggttcagtattcattaggctctggcagcccgcttgccggaggagattctaacggtgcgttattctatatcaaatatgaaagcgacacacctgactttgataaagaaaaagataacgttctgaaggaaatccaaaagcaatctgaccgcggagaatggaagtcacaggacttcagctcttcaggcaataacaacgaattaacatactatgtgtatggcgattctgaaaacgatattaaagacacggtcaaagatattgaaaaaatcatgaaggatgaaaaggatctgaaaaacgtaaattcaggcctttccagcacatatgatgagtacacatttgtcgctgaccaagaaaaactaagcaaactcggtttaaccgcgtctcaaatttctcaggccttaatgtcacaaacatcgcaagaaccgcttaccaccgtgaaaaaagacggcaaagagcttgatgtgaacattaagacagaaaaagacgagtataagagtgtgaaagatttagagaataaaaagatcacttccgcgactggccaggaagtcaaaatcggcgatgtggcaaaagtgaaggaaggatcaacatcagataccgtgtcaaaacgtgatggaaaagtctatgcggatgtcacaggtgaggttacatctgacaacgtcacagccgtatcaactgctatccagaagaaaatcgataagcttgaccatcctgataacgtatcgattgacacaggcggcgtatcagcggatatcgctgattccttcacgaagctcggtttagcgatgctggcagcaatagcgatcgtttaccttgtgctcgtgattaccttcggcggagcactagcgccatttgcgattctgttctcattgccgttcacagtcatcggtgccctggtcggactttacgtatcaggtgaaacgatcagtctgaacgccatgatcggtatgctcatgctgatcggtatcgttgtcacgaatgccattgtcttaattgaccgcgtgattcataaggaagcggaaggcctgtctacgagagaagcgctcctggaagccggctctacacgactccgtccgatcctgatgacagccattgcgacaatcggcgccttgattccattagccctcggcttcgaaggcggaagccaggtcatttcaaaaggactcggcgtcacggttatcggcggtttaatcagttcaacgcttctgacgctcttgatcgtgccaatcgtatatgaagtattggcgaagttccgcaagaaaaaaccgggaacggaagaagagtaaaaaaacaaaaagcctcagctatgctggggctttcagcttgttgaaaaaccctcgcattcgttgtcaggtctgcgcgtcggtgctcacgaattctacattcactccgctccaatgctcccccttcctagactacaagggttttcaatcaagctgaaagaatgttaaggatgacaaaagctcaaaacaagaatcagttttgagcttttgtgcgttttcacctgtaagattatgtacattttgttgcgatttttttaactcatagtataattaaaggttgttagtgtaaaaatggatcggatactcttaagtaggatgatgagataatgaaacgtgcacgcataatatacaatccgacttcaggacgggagatctttaaaaagcatcttgcccaggtcctgcaaaaatttgaacaagccggctatgaaacctccacccatgcgacgacatgcgcaggagacgctacacacgctgccaaggaagcggcattgcgtgagtttgacctgatcattgcggcaggcggagacggaacgatcaacgaggtcgtcaacgggcttgcgcctttagacaaccgtccgacactcggtgtgattcctgtcggcacaacgaacgacttcgccagagcgctcggcattccgcgcgaggatattttaaaagcagcagatacggtcattaacggcgttgcccgcccgattgacatcggacaggtcaacggccagtattttatcaatatcgccggaggaggccgcctgacggagctgacgtacgacgtgccaagcaaactcaaaacaatgctcggccagcttgcttattatttaaaaggaatggaaatgctgccttcacttcgtccgacagaagtcgagattgaatatgacggcaagctgtttcaaggtgaaatcatgctgtttttggtcacgctgacaaactccgtcggcgggttcgaaaagctcgcgccggattccagcctgaatgacggcatgtttgatttgatgatactaaagaaagcaaaccttgctgaatttatcagggtcgccacgatggcgcttcgcggcgaacacatcaacgaccagcacattatttatacaaaagcgaaccgcgtgaaagtcaatgtatcagaaaagatgcagctgaacctggacggcgagtacggcggcatgctgccgggcgaattcgtgaatctgtaccggcacattcacgtcgtcatgccgaaggagaaagcggaacagctggatgactaaaacttggctttgtaagccaagctcagaatgttgacaaaatcctaaaacagttttcgttttaggattttgtcatcttttcagcgtgattgaaaacctttgaagtctaggaagggcgagcatcggagcacagcgaatgttgaattcgtgagcaccgaagcacaggactgacaacgaatgcgaaggtttgcctacacgctgaaacttggcttgaataggccaagtttttctttcgcttaaaacaagaggtgaacatacatgaaaatgaaacccccagtagaaaaaaacgaatactatgacgtgacatttgaggatttgacccacgaaggagcgggtgtcgcaaaggtccaaggattcccgatctttgtgccgaacgccctgccggaggaaaaagcccaaatcaaagtcacacgtgtcaaaaaagggttcgccttcggccgtctgattgagctgaaggaagaaagcccgcatagaacggatgccccatgcccgatttacaagcaatgcggaggctgtcagcttcagcacatgacctacgaaggccagctcttgtttaaacagaaacaagtcaaagacgtcttagaacgcatcggcaagctggacctttcaaacgtcaccgtgcacccgacactcggcatggaagacccgtggaactacagaaacaaagcacaggtgccggtaggagaacgggaaggcggactcgtcgcgggattctatcagcaaagaagccatgacatcatcgacatgagcgcctgcctgatccagcaatccaaaaacgacgaagccgttcaagctgtcaaagacatttgcgcaaactacggtgtcaaagcctacaacgaagaacgccacaaaggctggctccgccacatcatggtcagatacggcgttgttacgggcgaaatgatgatcgtcttcatcacaagaacaagcgacttcccgcacaaagcgaagatcatcgaagacatcacagcgcaattcccgcacgtcaaatccatcgtgcaaaacatcaacccaaacaaaacaaacgtcatttttggcaacgaaacaaacgtcatctggggcgaagaatacatctacgacctcattggagacgtcaaattcgccatctccgccagatcgttctatcaggtcaatccggagcaaaccaaagtgctctacgacaaagcgcttgagtacgctgagcttcaaggggaagaaaccgtcatcgacgcctactgcggcatcggaacgatttctttatttctggcaaagcaagcgaaaaaagtgtacggcgtagaaattgtaccggaagcaattgaggatgccaaacgaaacgccgagctcaacggcatcacaaacgctgagttcgcggtcggggaagcggaaactgtgattccaaaatggtatgaagaaggcattacagctgatacgctagtcgtcgacccaccaagaaaaggctgcgacgaagccctcctgcggacgattgtggagatgaaaccgaagcgggtggtgtatgtgtcctgtaatcctggcacgcttgcgagagacctgcgggtggttgaggatggcgggtatcagacgctcgaagtgcagcctgtggatatgtttccgcatacgaatcatgtggagtgttgcgtgttgcttgaaaaaaacatgtgtgagttcgagaaattatagtatatctcggacttccgtcttctttaattcttcgatacactcaattggtttgtgaagaattttttcatcaatagttgggtttgagtgaattgttcaagttgttttagtaaatcatttaaattatctttaagtcggattaaggtctctaatcggagtctctacgcgattttgttttcagataggtatttgtttcaattggataggcttaacaaacaaatttgaaaaaagatcaataagcaacaagtcgaattaccagtcttacagatgtttaatacaatcgaaattgtcccctttgattatcaagggaagttagaggataacatagcagatgctattatgaccattaaaggagcaaataaatcttactttgatgtttgttgattttctttaacgctcattgttctaaagcaaatcttgacaaacggcaaattgtttttggtgttggtcaagatttggattgtctattgtttagaagacaccaataaaaactgcttttaaaaataattaagattgacaaatgaacgacgtagacagctttatgagcaaataaaccaattgtaaaggaaaaaaatcaaatataatcatattgttttcaatgaaaatgaaattacatttactattcccgatatcatagatgtaatcaataggatacaggctgtcataactcaattaaagcaagtgttaataaccgttgatccattggtaagtgaatatgccgaaacttgtgtaaggaagctctctaattagggggctttttgctttaaaaagaatagacatgtatcaattgacaaggaaaaggaaaaagttatatactgtatttaacaaatgttaaatcttctatttaacatagaaataggaggtgtaaaatgcaactcggcgatattgctaatgtaaagacagggcttgtgttaagtaggaaaaaggcagaagttgaatatgatgcgaaagctacatacaagctactttcactcaaaaatattgcggaagatggcatgattgaaaacgattcgtttgaggagtttgtaagtaatgacgatttagacgatcactactttacaaaagaaggtgatgtgctaatgcggttgagccacccacacacagcggttttcattgaaaaacaatatgaagggttgttaattccatcgtatttcgccatcattaaagtagacaaaacaaggttcctacgagagtacattgcatggtatctaaactcatttgaagtaaaaaaagagttggaacgctctcagtcaggtagtcgtatccccagtaccaatcaaaatgtaattaaaacactccctgttgtctggacaactctatcaaagcaaaaagcattaatcgaactttacaagctccatcaaaaagaaaaaatgctttataagagattaattgaggaaaaagacttattattccaagcgatttcacaacaaattttaaaggattcaaaatcggagggaaatattaatgattgaactaacaacacaagacaaaattaacagtgttttatggcaggccgcagatacttttagagggaaaattgattcctcaacatataaagattatattctaacaatgctatttataaagtatttaagtgatacatacaaggagcatttggaagaatatacgaagaaatataatggtgatgaacgacgcattgaacgtgctttatcaagagaacgttttgtacttgatgaacaatctacttttgattatttgtatagcaaaagaaatgatcctaaaattggagaaatcattaacaaagcattggaacgcattgaaaatgaaaacacaggtaaacttcgtggtgtatttcgtaacattgactttaacagtgaatcaatccttgggcaagcgaaagagcgaaatgcaatgttacgatcacttttggaggattttagacatttatctctaagaccatcacagttaggaaatgaagatatagtagggaatgcataccagtacatgattggactttttgcatcggatgcaggtaaaaagggtggcgagttctatacacccgctgaagtatcagaattactggcacgtttagttaaaccgcaagaaaacgaccgtatttatgatccaacatgcggatcaggttcgttgttaataaaagtggctaaacaggttccaagtagaaaagttgctatatacggtcaggaacgtaatggtgcaactcattcattagctcttatgaacatgtacctacatggggttgacgatgctaagattgagtggggcgatacattagcaaatcccttacatttagaggatggaaagttgatgaagttccaagcaatcgttgctaatcctccattttcattagataagtgggctatgggcttcgcaggagaaggaacaaatgacaaaaaatttaaaatggagtcaagttttgatccctatagacgttttgagtggggagtacctccaagttcaaaaggagactatgcatttgttcaacatatgctttattcattagctgaaaatggacgtatggctactattcttccacatggcgtactgttccgaggggcaagtgaagggaaaatacgtcaacaaattattgagatgaacttattggatgcggttattggtttaccagaaggattattttttggaacaagtattcctgcgtgtatcatggtatttaaaaaagaccgaaaacgaaatgatgttctttttattgatgcatctactgaagaacattttgaaaaaggaaaaaatcaaaattaccttcgagaaaaggatattgagagaattgttaggacatatgagaatcgggaaacaattgaaagatactcttatttggcaacaatagatgaaataaaagaaagtgaatttaatctaaatattccaagatatgtggacacttacgaagaagaggaacctgtcgatatgattacagtgaaaaataatatttcgaatataaagaaggaactacaagaagtagagttacaaatggagaagtatttgaaagagcttggattgtaggtgaatatacttgactaaaaataattatgttagaacggcgattggagaattaccttcagattgggaagtagaacttcttgataatatagcagaaagaaaatctggtcatacaccagataagaagatagaagagtattggaacggaaatattccctggatttcattgaaagacttatcacgattaaataaagggtttgtatatgaaacaacggattttacaacaaatgaagggattaagaactcttctgctgttttgttacctcaggggacaatagtcatttcaagggatgctacagttggaaaggttggaattcttgctgaggagatggctacgagtcaacattttatcaattatatttgtggggatagactgaataacgtttatctatactaccatttactatttagaaaccacattttcgaaaggattgctacaggaagcacaattaaaacaattggtttaagtttctttaaaaaactaaaggtagcactacctccaattagggaacaagaaagaattgcttctatcctttctgcttgggacaatacaattgatttaaaagaaaaactaattgattataaaaatgagcagaaacaaggattaatgcaaagattattgacaggagaagtaagattgccagggtttaagggggaatggaaaaaggaaaggattggtaaactcataactgaaagtaaagaaatagcaagtaaaccagatcttaataaaagaataaccgttagacttaatttaaaaggtattcagaaaagagatgtttcatctacagaaaaggaagatgctacaactcaataccttagaaagtcaggacaatttatttacggaaagcaaaatcttcataagggagcttttggcataattcctaaagcgttagaaggttatcaatcttcttcagatattcctgcattcaattttaatgaggaagttgatccttattggtttttttactatttttcaagggagagcttttatacaaacttggagaaaatatcaactggtacaggatcgaaaagaattaacccaaaagatttgtttaaggttaaaatccattttccaccttatacagaacaacaaaaactttcagaagtctttttatgttttgatagagagattagtctacttaaagaagaggtcgaagcattaaaagaacagaaaaaaggtcttatgcaattacttttaacggggaaagtcagagtaagggtataaatcatttactttatttcttcgtttttattaggaggtgtagagatggcaagggagaagagttatgatgaacgttacataagccaagttcctgcaattgaggttcttcgaaggttaggttatcaatatcttgaaccagaagaagccgagcagatgcgtgggaatttgtacaacgtattacttagaaatgttttgcaagaaaagttacggtcatttaattcttatgaatacaaaggggaaatatataagtttagtgactccaatatccaacaagctattcgagatttagatgaaccattaacaaatggtcttgtaaagacaaatgaagcgatttatgaaacgttaatgaaaggaagaacatattctgagtttttacctgatggctcaaaaaagtcatttacaattcaatttattgattggaagaacattgaaaataatgtgtttcatatagtggaagagtttaatgtggaacggatggatggacgtggaaacgttcggcctgatattttactgtttgtaaatggtattccttttgttgtaattgaatgtaagaaagcatccatctcgatggaacaagggataagtcaaatgattcgaaatcagggtaaggattatgttcctcaactgtttaagtttgtacaaatggttatgtctactaacaaaaatgaaactaagtatgcaacatgtaatacaccaaaaaagttttggtctgtatggaaggaagaaaaagaagtatggttagagtcttggttggacaaagctgtagaaagtagattgccaacaacacaggataagaatattatttctctgtttcatcctaagcgtttattagagatcactcaatttttcactctgttcgataaagacgtcaaaaaagtagctcgttatcaacaatattttgctataaaagaaatcattaaaacaattcaagaaagagatgaacatgggaatcgtcaaagtggtgtgatttggcatacacaaggatcaggaaaatcactaacgatggtgatgttagccaaatacattctttctgagttgtttgaatataatccgaaagttgttgttgttacagatcgggttgaattggataaacagattcataagacgttccgtcatacaagattaaaggcaagtagagcaacatcgggcggccatttaattgatctaatcaatgacaacaatgctgatattgtcacaacgttggttcataagttcgatacagcatcttcaaaacaaaaaccaattgagtcaaaggacatttttgttttagtagatgaatctcaccgaacacaatacggagagcttaatataaaaatgaaaaaggttttccctaatgcatgctacttaggttttacaggcacgccgttaatgaaaaaagaaaaaaatacgatgattaaatttggaaagctaattcacacatatacaattgcagatggtgtacgggataaggctattgtcccgttattatatgaaggaaaaatggttgatcaatcggttaatcaaaaggctattgataacagattagagatgattactcgtaatctaaatgacaagcaaaaggaagaagtaatgaaaaagtggagccaatttgaacgaattgcttcctccaaccaaagaataagtatggttgcatttgacataaatgaacatttttttaagaattacaaaacacaaggaagcaactttaaagcgatgttagctacaaatagcaagattgaggctattcgttactttgaatcatttgaagaacttggcgatttgaattgtgctgtagttatttctccacctgaccaacgtgagggacatgaagtggtcgatgtggaatcaaaggacaaagtacagcatttttggaaaagaatgatggatcgttatggaacacctgaagactatgaggatgccataaaagatgaatttattaatggtgatgaaattgacttactcattgtcgttgataaattgctcacaggttttgatgctccgagagctacagtgttgtatgttgataagccaatgaaagaacacactcttctacaagcgatagcgagggtaaaccgtctatatgaaggaaaggattatggctttatagtagattatagagggttattagataaacttgatcaagcaatgcaaatgtactcaggagcagggttagaaaactttgatcctaaggatttagagggagctatacatgatgtcattagtgtaattggttcgttaagacaatttcattctgatttattacaaatatttgctcctattaagaataaacaagatgttgaagagtatgaagtatggttagaagatgaagaacttcgagagagattttatgatgtattaagcaactttgggcggaatcttggtattgcattagaatctgaaaaaattcacaatgctctacggccagaggaacttcaaaagtataagaaagacttgaagtttttccaagagctaagaaaaagtgtgaagctccgctattccgacacaattgatcataaggaatacgaggcaaaaatgcaaaagctaatggataattacatttctgccgaagagattatccgtattacaaatcctgtagatattttaaatgaaaaagcattcgaggaagaattagaacgcctggattcaaaacgtgctaaagctgatgccattcgtactcgtttaacgaaaagtgtaagtgcaaaatgggatgaaaaccctgcattttataaaaagttctctgaacgtattcaagaagctattaaagaatacaaggataaacgaatctccgaagcagagtatctgaatcgaataaaggatataatgaaagattatcgcaaaggtgaatcaaatgacgattatccagaagtgattaaggaaaatcgaaaagcacaagcgttttatggagttgcaaaagaccttatgagcgaagttgcggagatttctgaaagttatggttcggatacactcggagatttagctttaaaaacggataaagtgattaaagaacaccaaaaggttgactggcataataatcttgaaattcacaatcgaattgcacaggacttagatgatcttctctttgattttgcagaagaaaatgggatagaaatagattatgatacaattgataaacttatagagcaaattaaaaccgttgctcttagacgttattaaggttgtgaacagcatggagagacatcaaatccagtacgtaaataaaataattgactttgctattcaacgaaagaatgttaagaatgttaatcttaacattaagcctgatatgacaatagaggtgtctgcacatgatgccgttccgttgaatttcatttatgattttgtgaaaagcaaaggtgcatggattgttaagaatgtaaaaaactttgaaaatgcacaaccaaatagccaaagtgggcgagagtatgtaagtggtgaatcctttaagtaccttggaaaacaatatcgtctacgagtgcaaaatactgaggaagaggaaatagtaaaatacttccgaggatttatctatttattcgttaaagatcccaatgattacgaccgcaaagctaaacttatggatgaatggtatcgtgagaaagcatttatgacatttcaggaatctcttaataagcaacttccattagtacaaaagtacggagttgataaacctaatcttgatttacgtacaatgaaagctcgttggggttccgctttaaccgacaagaatacgattttattaaatacagagctgataaaagcgccaaaattttgtatagattatgtaactttacatgagttaatccattttaagtacaatgaccatagtgaaagattttatgatatgctgtactcattaatgcccgattgggaaaagagaaaagcaattttagatgaagagattgtaaaagacttataagaaaaagaacctctttggcaacttaacaaccagattaatcaacaaaaggcagttcctaattttcatgtggagactgcctttttaatttcttattcggattttattggagaattggtctacaaaattgaggattaattgagaggtgaggtcttggacgaaaatatgtgggaattgtcgttcgcaagtggcaacaaactgcttcacacttcatctgaaatacggtgattcttcataacaggattagatgaacgaggattcgcttgtccaatgtgagtcatcattatctttcattctttcaactaaagacgcgataatagagaaatttttcctaataaaggctatctcgtcactttctgataaaggattttcaataatgaggttatcatcttttacaaatttgcaatctttgctaaccgcttgatgtacacgtaatggttttgcaacacgctgtaggtcgttctcttcttttgggagaagatcatttacaatttggacatgctgtttgctacttatggcagtgaactgtctttgttcatgggtataactctttaaaaaataatgtttattatagtttgataacatgaaattattctcattcggaggaggttttttattggataatacgtataatccttttgataagatgcagtttacatataacaattgtttcctttgtgggagtaaagatgtttcgcaaaaaactttagagcatgtattcccaaagtggttgttaaaaaggtttgagttatggaataagcaaatacaattattaaatggtacattaatttcatataggcaattgaccattccttgttgtaacaaatgtaacaacgaatatttatcacgtattgaaaacaaatttaggagggctgttgacaatggatatgatgcatttttaaatctagatgaagaaaccatctttttgtggtctgcaaaaattttatatggccttttatataagcaattatctttaccatttgataggaagtcaccgcgattgggaaccattacaagtcctgatctattagagaaatataggattctacatttattgttacaaggtgcgaggtataaaactaaatacgaagggaaaccatggtcaatctttattttccagagtcaagaatataaggatgaaagagattttgattatttcgatggattgttttccttagtgttagggattcgtattggaagagttagctttgtaatttgttttgaagatgcgggcatacagaaagtaatgtttgaggattattttagggatttgcaagagatatcattacatccgattcagtttaaggagatcatagcgaaagtacattataagcaaatcttatttagaaaaaatcctttctttatggttgttgaaggaaaagaaaacgatagaactgttttagtgaatcaaccaacaggagacttatttgatgaatgggatttcgaagattattcaaaaattttatcattgttttttaaaccttatggattacatttaaaagatatttatcacccacctggtaaaaccattagttttttatatggagaagaaggggaagttaaacatataccaaaataggtgtattatgaatgacaagataaataaaaaatgtataatttagggaaataagtcatctttgaaggcattgggaagaacccaatgctgtttttcattgttttacttttttgatttagttaatgccttctgctacctattgatataattcacccattttttctgtttccatagaaacctccagttttatttcaaaagctatatcaaatttatagatgtaggtagctaattaaaaattctttatcatcctcgtcttcaggcaaaataccaagagttttgtactcccataatgcaattctttgataccatctaactcagacgccaaaatatcgacattattataatcaagttggaattgactattgctatccaatgccaatgtatggttagtccaaacctgatcattattattttggtgcgcaattcttaatttctcaaaaagttctcggatttcccttaataaagttttgaagatatctttacttacgttgtattgggcaggtatatcttgtgaataaataatttggattattttctggttacttgaagtgaaagagaaccatggtagaatcatttaatacttctacataaagataaatttttgtccattcataaggtatgatgttatttaatttctgattaataagctgatacaaatcttgcatttttttagtttccaatcttttcaccttcaatcgtcgagaaatcttagttatcaaaatagctcagcagagaagggctgagccatttttgatttatagaccgaagtagtttattacaaattctttgtcgtcctcatctttaggcaatatccctaaattttgatatttccaaacatctcgtctttgaaggtcatcaagttcagaggataaaacattatcataattataatcaattgaaaactttccggtgttttctaattttaaagtgagattagtccaaatatcttggttgcctagtttaaattcctcttttagttcttcaaatagcttttgaatttcaattagcagttgatcgtaaatctcttcactcacatcaaagtgttccggtatataatgagaaaataaataatcactgttatttggtgttgtaaaataaaagtatatatctgctgagtcaccaagtatttcagcatataaaacgatcttttcccattgagatggaatcatttcatttagatgttcagcaatcttttgatatagttcacccattttttgagtttccattagattaacctctaactttgaattgttgatggcattatttaatatttaaataatccttaacaaattctttatcctcttcgtcttcggggaaaatacccaagttattgaactcccaaatcatttgtctttcgtattcgtccaaatcagactcaataacatcttcataatcataatcaattgaaaactttccagagctttcaagattcagtgtcaaatttgtccatgcttcgggattattttctttaaattcagtgtgtaactgcttaaacaactcttggaggtctagtagtagttcggtataaatttttttactgacctgaaattgttctggaatgtcgtgagagtatatatattcatcgttttctggtgtttgaaagaaaaaatacacttctctggaaccatctagtatttctgcataaagaacaactttgctccattcggaagggatcatgtcattaatttgttctgctattttttgatatagcacttccatcttttttgtttccactagattaaccccctggtttattttctatagtaacttgtctcgctctacgattacctatcttatattcaacattaaataatacaggtctaagtgaatctccctgataaaccggttctatattaacttttacttgcttaggaggttttccatttaacgcctttgaccacacttgctccattttgtaccatttcccgccgctcctattaatctgagaattcatcggcacgatattgtcgaactggcctgagcctttgaattgggtggcgattaaatggccgccgtcatcgtcaggctttcggtcctggggctttccagcattcgtctgtgcatattggtttcgttttgcttctcccagctgcaagtctgctttgacacttgtaattctaccatagttgtcagtcgtgtatgtgtagccttcttttgttttgtagatgatattgggcttcagcactttctttctgctccatcttgcgaaatgctcgccgtatttgacggttaccggcggtacatgtggtgctggagttcgtcttccgcttgatgacgttccgtatggtttcggaaggatgaccttggcgaatttttgcagtccttctttaagcgtgaccccgttgactgcgttgtaaggaacgcctgccggcactaaatcgtgacggggatgataggggagaatatccgcaagtgtgagatctccgatttgatttaatttggttttgacgtgtttttttgatacttctatgcctgtgtttactttttgtttgatgtgatcaacggtttgttttgagactgttatggctttttgggctgttgcagatttgcttgctgctgttttgacttttgccgtcactttggcggctgtgccagtttttgagacggcgccaacaccttttgtgccgacaactgatgtgacaacagtgcccactgcatatgagacccatcttgctcttgagtaggtgtcaccattcaccatgtctttttcgtatgattcttcgattgctgctgaaatggcttcatacgttttgatcgggtgagccacagctccggtaatcgcttcaacggttcctcccggatctgtgaccatatcccacaggcctacgaccgcgtccttcccggaatcataaaggccgacggcgacccctttgaagcctgcttcaagctcacgcgtgttttcaatttgggtgaagtatctctgctgttctgctgtcagattttcatagccaatcgtctttgccattgagtagaattcatcggcatccgcataatcatagtttttcagtctttctttcagtttttcaatctcgcgttccttcgcttcctctttcttaatcttcaagtaagcctcagtccgcttttcaatgtcgccttttttcttatgtatgtcactctcacggtacgctttggcgttgtagtggatgggtgtggcgtttttgcctttgcctgttgcttcttggagcttttggaagtcggacttgatgaattgttcgtttggttctgacagggcgtattctgtcttcaggtcttcgtccaaggcgtccaatttttccagtgtttttttgcgtttgtcgttggcatcggccagctcgtctttgaaggtttctgttgaaaacaggtcgagcgggaggatgtcgtcgatatcgttcaggatgtctttcatcgcttttttctgttcggacatgatggattttgattttttattggcatttgccagttcgtgctccaggaaggattcttcgatgtatgcgtcagagagggctttgtccttcgcggctccggcgatgctattgaaaaatgcgattttcatgtcgatgtagtcgatccattggtcggtgacgccgacgtggtcgtgatagaaggctttgatgttgctggcgccttttcctgaaaattcgctgtcactgagatcagcgacactttttaacgcttttctcaagttgaccatttgcgttcttagttctttgtactcttttgcacggtctgtcgcttccgaaagcagtgttttcgcttcaaatactttcatgaccatttcccttcttttgttcgctcaatatcaaaattttaccacggggcgggatgagggtgggggtgagaacgtgttttggtggaaaaatgagtcatttggcatgtgtctaagtacacggttttgatatgatgatgatagatcaattaaaaggggaagagctcatttggataaagatttcttaatcataaagatcaaggatattcaaaaaggcgacacgctaacgaaccgcgcctgcgggaactgggatatgaaattgtccagagcaaaagaatgtaaacgggcaattgttgttcggagcggtgtgattttaaatgtttacaagatcgttgacgcttgggaatcagatgaacccgccaagctcactaaaacgaataatagagttcggtttcaattggcagagtgccatgactattcttatatgattggcggtacgctgaaaacgaaaacgcaaaatccggtttcgagtctatccttagaaaccttaatggaactagtaaaataaaaggagcccagcatgtatctctataaagtaaacagccaaaaccaaatcgaagatattcgcgagaaaccgtttaaaaaagaaaaagagattcaggatttatgtgaaatcaatcttcagcggatgttggggctcaggtttgtgaaatctgaattcaggatcagcaatttccgcattgatacgttagcgtttgatgatgagacaaatgctttcgtgattatcgagtataaaaatacgaaaaacttcagtgttgttgaccagggctacgcctacttagcagcaatgctcaatcataaagcagatttcattcttgagtacaatgaaaatcatgatcttccgttaaagcgggatgatgtagactggtcgcagtcgaaggtcatttttatctcacctgtatttacggtgtatcaaaagcaatcgatccattttaaagatctgccaattgaattgtgggagattaaaaggtacgaaaatgatctgatccagttgaatcaaatgaaggctgatggcgtctccgagtcgattaagaccatttcacggcaaagtgagaccattcaagaggtcagcaaagaaattaaagtgttttctgaagaggatcatcttgcagataaaccgtttgacatcatagagctttatcagcagctaaaggaattcatttttaatttggacgatcatatttcaatcaaaccgacaaagctttatattgcgtttacatcaaataagcgaaatttcactgacattcttcttttaaaaagcggacttaagctgtgggtgaatatgaaaaagggagaattgcatgatcccgaggacagaatgcgcgatgtctctgagaccggccactggggaaatggcgactatgaaattttcataaaagatgatgaacacattgaatatatcatgggattgatcaaacaatcctatgagaaaaataagtgagaacttccattgagaagttcttttttattgtggcatgctaaagaagaattcatttcagtccctttcttcttctgtaaaaatgaaatgtacaaactgacaaaagacctataaaatgagaaagctatcatgagagagcagaagggtgagagagacaatgagttataaattagttgcgatgcttttatcgatactattcctattatcggcgtgttctaatagcggatcttctgataaggatcaggaaaagcaagcagtgaagaaagcgagcgttgcgatgctgacggagcaggaagtaaaatcagctttgaaaaacgatattgattcgatctttaatgcatttgataaagcgggaaaagaaaacggctggagcacggcaaacaaggcggatttcaacaagctgcggcctagtgtgctgccttatgcaacagaaacgtttgcagatcagaccttaaaggatttggccggagagtactattgcgagtgtgatgatccttttcaacccggctctgatttcgatgtgcgttttacatatgaacaggacaagaataagatagaggcttcatcaatagacccggcaacagaattaaacaacatgggcacggaatggacgtttgaattgatgaagcaagacggtaattggaagatcaacaaatgggacagcaagtcgcttcaaggggatgatatcaagctgacaaaagaagaagcgaaaacgattctgtctagaaacggtgaaacggcggaatttgtgaagtcctatgaatcgaaggctgccggcggaacagcttatcttttcaatgtgaaaagttcaaatggggaaagacaggcggcgatcagctcaaaggataccagtctggtaagtgataatgaaaacgagactgaagctccggagcaagagacagctcagacgactgcggaaaccgcatcgcctgatacagcggatacacagagcagtgagcagacaacaggaagcacaaaagcagattatgttgccaaattgtcagcgacagaacagaaagaaaagcacaatgactatcaaagtgattatcagatgattgaggattacggttacaattatcaaatgtgggacggattgctgaacgagatatacggcgtgctgcaaaagcagctttctgccccagacatggcggcattaaaagtgaaacagcgccaatggataaaggatagggatgctgcagcccagaagcgatatgatgaggagggcggcggttcattatcccgagtcgtccaaacggaagagcttgccaaacagacgaaagagcgctgttacgagctggtgaatacgtatttgaaataagattgacatgggacccttgcataaagggttcttttttatgaaaaaaacaaattgacaggatgaaaaaacaatttcttccttctatattgttttcaaaatttgggattgatagaatatgacatatctcatagagaaggagggaagccgttgagtcaagccataccgtcttcgcgtgttggtgttaagattaatgaatggtataaaatgattcgccagttcagtgttccggatgctgaggttctgaaagcggaggttgagcaggacattcagcagatggaagaagaccaggatttgctgatctattattctctgatgtgttttcggcaccagctgatgcttgattatttggagccgggacaaacatacgggaatcgccctacagtgacagagcttcttgaaacgatcgagacccctcagaaaaaactcacaggccttttgaaatattactctttgtttttccgcggcatgtatgaatttgatcaaaaagaatatgtggaagcgatcgggtattatcgcgaggcggagaaagaactgccgattgtgtctgatgaaattgagaaagccgaattccattttaaagtggccgaagcgtattatcacatgaagcaaacccatgtgtcgatgcaccatattcttcaggccttggacatttatcaaaaccatcccctatacagcattagaacgatacaaagcttgtttgtgatcgccggcaactatgatgatttcaaacactatgataaagcgctcccgcatttagaggcggcgctagatttggcaatggacattcaaaatgacaggtttatcgccatttctctattgaacatcgcgaacagctatgacagatcaggagacgatcagatggctgtagaacatttccaaaaagcggcgaaagtaagcagagagaaagtgcctgatctgcttccgaaagtcttgtttggattaagctggacattatgtaaagcgggccaaacacagaaggcgtttcagttcatagaggaaggattagaccatatcacagcacgttctcacaaattttataaagaattgtttctgttcttgcaggccgtgtacaaggagactgttgatgaacgaaaaattcatgatcttttaagctatttcgaaaaaaagaacctgcacgcgtacattgaagcatgtgcccggagtgctgccgctgtttttgaaagcagctgtcactttgaacaagctgctaagttttaccggaaagtgctgaaagcccaagaagatattctaaaaggagagtgtttatatgcctattaagaaaaaagtgatgatgtgtctggctgttactttagttttcggaagcatgtcgtacccattcctgacaaactccggcggcgttaaggaatcaacagatcgaaatacgacgtatatcgatcattccccttacaaacttagtgatcagaagaaagcccttagctagggctttttcttgctttacggaagacgttccattttccacatcacggcattccttctatttctaacgcaagacactcgaaacaaccaaaccatttgaggtataatggataaagtgaataacagtatttagattgatatatatgaaagagagtggaacatcatgggccgtaagtggaacaatattaaagagaagaaggcgtctaaggacgcaaatacgagtcgaatttatgcgaagtttggccgtgagatttatgtggcggcgaaacagggcgagcctgatccggaatccaaccaggcgctgaaggttgtgcttgagcgtgcgaagacttacagcgtgccgaaaaacatcattgaacgtgcgatcgagaaggcgaagggcggagcggaagagaattacgatgagcttcgttatgagggcttcgggccgaacggatcaatgattatcgttgatgcgctgacgaataatgtaaaccgtacggcgccggaagtgcgtgcggcgttcgggaaaaacggcggaaacatgggtgtgagcggatctgttgcttacatgtttgacgcgacggctgtaatcggtgtggaaggcaaaacggctgacgaagcgcttgaaatcctgatggaagcggatgttgatgtacgtgacattttagaagaggatgacagcgtgatcgtatatgctgagcctgatcaattccatgcggtgcaagaggcgtttaaaaacgcgggtgtcgaggaatttacagtagcggagctgacaatgcttgcgcaaagtgaagtaacgcttccggatgatgcaaaggaacagtttgaaaaattaattgatgcattagaagatttggaagatgttcagcaggtatatcataacgttgatttaggtgagtaaggagtgagcaggctgttatggcctgctttttttgtcccggaaattgttttagctgtatgtaggcggccgcctatacgatctataagatattctcatactctggactgtaacctatgtgaaggagagagtgaatatgactgatacaagacatatgtatggcggacctggttttggtcattatcagggctttggtattggccacccgggttatggcatgtatggaggccacccgggctttggcatgtatggaggctacccagatcacggcatacatggaggtgtcggcggctatccgggatatggaacgtacggaggatacggaggatccggcggttacccaagcggcggctatggaggctctccgggaactgtaaattatccgaacatgcaccatgaaaatgatggccatcaccactattatcaccatcatcatgatggaaaagataatcttcatcaccatcatcatgatggtcattatggccaccatcaccaccatatgggccactggggaaaagacggttataaataaagaagatgatggtataaagaggacactcttgcagatcaagagtgttttttatcttttttcttgactgttcagtctggaaactggtaacatttgtttcaggaggtgatcgtcttttggggaggaataaagaatttgatacggcacttgttcttcacagggcgatagaggtttttggagagtatggctacgaaggaacgtctcttcaggatctgctctctcatttaggcattgcgcgccagagcttgtatgatacgtatggcacgaagcgtgatttatttttgtccgctgtgaaaacgtatcttgaagggaaaaacactgccgttatggaaaggcttgaagcgccaggatctgtaaaggaagccattcgtgatatttttcaagaaggtgtcaatgctctgagggaccctgaacgggcgaaggcgtgctatatcattaacagcgcgattgaacagattccgcatgaccctgagcttgccctgtattttgaaagacaatccaagcagcttgaggacgctttttatcaggcgcttttaagagcgaaggaccaaggagaattgaatggcgaagatactgatatatctgcgcttgcccggtacctgaatcaaagcaggctgtctctgacatttgttgcgaaagtgacggctgatatggatcggcttcaggaccatgttgacgtgagtttatcagtgcttgattaacatgtggtaaaggattctttgcccatgtatgtatttttcggactgaatagtctagaaataaaaatgaggtgatgatgaatgttgatgaatgaatttgaaaaagcatgtgaaacattgagaaagtttatggcttatatgcttgagaaggacatgaagagctggacggagctttgggatgagaatgctgtatttgagttcccttatgcgccggagggatcaccaaaaagaatagaaggaaaagcggccatttacgattatattaaggattatcctaagcagatccatctttcttcatttaccactccgacagtgtaccgttcagcagactcgaatacggtgattgcggagtttcaatgtgacggccatgtgattgagactggactgccttatcgccaaagctatatcagtgtcatcgaaacgagagacggccgcattgtgcgttatagggattattggaatccgcttgttgtaaaagaggcctttggaggatcatttttgcaaacagaggagagtgggaaatgatgaaacagaatccgattttaatcacgggcgggactggcacagtcggcagccgaatcgccagccgtttaataaagctgggatacagagtgcgtattgcaagccgaaaaaagggcgcgcttgcaagtgcggagtatgtgtattttgattggaaggatgcctccagttttacgcctgctctagaacaggtaaaagacatctatcttgttgctccggttggtgtacttgatccggctccctatgtgcttccctttttaaaggaagcaaagcgtctcggcgcaaagcgggtagtgatgcaaagtgcgtctgttgtctccgagaacggtcccgtgtttggcgcgcttcaccaggcagtgcgcgagtttccagaatggacggtgctgcggccctcatactttatgcaaaatttcatcaatgtccagcaccgcatgtctattcaaacggaggggcgcatcacaacggcttcgggtgaaggaaaacttgggtttattgacgctgatgacatcgcagaaacagccgtcagggctttgattgatgatgttcctcatcaaacacatcatattctgacaggtcccgaggcgctgagctatgccgaagcggcggagatcattggagctgcggcgggacgccgggtggagcatgtcagcatttctcgttccgagctgcagcataaaatggaggcaggaggtttgcccgcggattatgcccattttatggcgaagcttgatgaggcaatcagccatggtgcggaacatcgggtaacggatacagtgaagcatgtgacgggaaaagaacctcgttcgctgtcagagtttgcggctgctcatgctgcatattggaaacactgacctcattttggactgaatagtctagaaagaccttcggcgcttccgaaggtcttcttattgaaaaagctaagtcgtgttttagtcataatcatgcctcctgcctcatacctattaaggtcattgtttttgagaaaggaggagccggaatgaaggatatgcagccgtttacgcctgtcaaatcatatacgccctttcacagccgttttgatccctgtccgcccatagggaagaaatattacagaacgccccctaacctttatatgacctttcagcctgagcatatggagcagttttcgccgatggaggctttgaggaaaggcaccctttggaaggatctctatgatttttatgaaaacccttatcgagggggagacgcacatggcaaaaaaggttgacgccgaatattatcgtcagcttgagcaaatacaggctgctgattttgtgcttgttgagctgagtctttatttaaatacacatcctcatgatgaagatgcgctgaagcaattcaatcaatattccggctattcaaggcacttaaaaagacagttcgaatcctcttacggaccgcttctgcagttcggcaacagccccgcgggcaaggattgggattggggaaaagggccatggccgtggcaagtataaggaggaatgcctgaatgtgggtgtatgaaaagaagctgcaataccctgtcaaggtcagtacgtgcaacccgacgctggcgaagtatttgattgaacagtatggcggagcggacggcgagctggccgcggctctccggtatttgaaccagcgttatacgattcctgataaggtcatcggccttttaacagatatcggtacggaggagtttgcccatttggaaatgattgcgaccatggtctataagttaacaaaagacgccacaccggagcagctgcgtgaagccgggcttggcgatcattacgtcaatcacgacagcgcgcttttttatcataatgcggcgggcgtgccgtttaccgcgagctatatccaagcgaagggcgatccgattgccgatttatacgaagatattgccgcagaagaaaaggcgcgggcgacgtatcaatggctgattgatatttcggatgatcctgatttaaacgattccctgcgttttttgcgtgagcgtgaaatcgtacactctatgcgcttcagagaagcggttgaaattttaaaagaagaacgggataaaaagaagattttctaataggcagattggcctctctttcatacacccttttacatacagagaaaatggtctgtttttgcagtttggtctgcattataatcaagggtgtgtaagcttactttttgattgggaggcctttatgtcagcttttaagattgagaacgaaacgattgcagatggattttacgcgtgtccggccgtctatgaggatgcagaatcgattaccgggttgctcgtccgaacagctgaatggctccgggatcggggttctaaccaatggagcggacttctcaaagggcaagatatacatgatatcacggggtcaattgaaaagggacatgtgtttgtgtttaaaaaagatgaagagcttgcggctgtcgtgatgctgctgcctgcaccgagcgagtgggaccggaagctttggggagacgatgggcatgaggagtccatttatttgcatcgcctcgcagtaagccgccggtttgcgggacaggggcttggagcccgcgtccttcagtgggcggagacgggcatacactttccgggaaaaacacggatccggcttgactgtgtcgctgataacgacgccctgcattccttttatcggcgtatgggatatgaattcatgggtgctgatgcgtccggatatcatttgtttgagaaagagattacggcagaataagcgtcctttgcagggggcttttttgtcttttctaaaagggagggcaggcgatgttgtggccaattttatttgtgacagggattgtgacggcttgtctgtttgctggcgtatccgttttgatgcggatgagatttcctgacaaaagtcggccggaatggatgttggccgggctgatcgtccttggtgtgtttgcgatctggtacagcctcgtgtatgtacgcggctgggaaggggctgcgctcggaatgcttggattcaatgtcattttcggagccattgccggatatttgatcgataaggccatccggcgttacaggaaaagataaggctgctgccgtctctcatcatgtcgaaattttcacagaccggcaggaattttctttcgaaaggagaaatacatattactttaaaatgaaagcgttttccaaagcgggaaggtgatgttgatgatacacagtgtgacaaatgggctgaatcgtttttgtacgtgggtgatgagactggcctatttgaatgtgctttggattttgttttctcttgcaggcctggttgtgtttgggctgatgcccgctactgccgcgatgtttacagtggcgagagaatgggcgaaggggaatacagatgccccggtgttttctgtcttttttcgggcgtttaaaaaggaatggcgggcatcacagatcctcgggcttatcgttgtgacggctgccctgtttctgtttgcggatatgcggatagcggctcagatggaccagcctgtgctcgtcaatgtattcctgagcattagtttgattttcgcgtttgttgtgctgtatgtgttcccggtattttctcattttgacgtaaaaatcagagaggtgctgagcatcagctttttcattgccttcagccgtccggcggtgacgcttttgatggcggcgggcgctgtcggtgtgctttgtctcgttctgtttcatgtcacgtttctattgtttttcagcgggagtttactcagcctgatcttaacgaagctgtcctttaaagcgtttcggtcaatggatcagcggcaggagaaagaaaaggcggcatgaagaaaagagttgctggctggtacaggcggatgaagattaaggataagctgtttgtgtttctatcgttgattatggccgtatcctttctgtttgtatacagcggggtccagtatgcctttcatgtgtatgatgagcagatttaccgcaagtcctcggaggtgcttcggatgtcttctgaaaggatcgaagacgagctgaagaagatagaggatgtgtcatatgaaatcattacggacgaacagattcagcgcatcctgagcatgcaaaatcgcgatgatacgtacgatcagtatcaaatgaagcaggagctgtgggatcagctggcgggatatgccagcgatgaaaagtacatcgattccattcatgtgattgatgcccgcggctcagagtattcagccggaagcagttcttcagatcttttgcagcaggagcaggaagaggtatttaagcgagcgaaagcgaaaaatggaagaaatctttggatgacgctcggcgggtcagatcctgtcctgatttcagcacggcagatcaggtcctatcaccagctgagtttgaacggcttgggcatggtgctgatccaggtcaatgtaaaacagatgattcgtgatgtgccgaaggattggggcgattcagtcggagacattatgattgctgaccaaggcgggaatttggtgtatacggcacatgcatcagcgcatgttcctgaggcagcaaaagagacgctgaagcaccccggttatgacttgataaaaaagaatggcaaacgttactttatttcttatcttcaatcatcctaccaaaattggagctactataacgttatcccctttgatcagatgttcgcgaaaatttcctttatgaaaacagtgatcggcacatgctttctcctctttttctgtgtggttttgcttttcggaaggaaaatcgccaacagcatcacggagccgattgaacagcttgtgaccgcgatgaaatcggtacagcacggcggcattgaagcaggtgtgtcgctttctctgccggaacatacacaggatgaggccggcatgctgaaccgtcattttactgtcatgatgaaacggattaatgagctgatggaagaaaatgtggaaaaacagctcatcattaaagaaaccgaattgaaagcactgcaagcccagatcaatccgcattttttatataacacgctcgagtccatcaattggctggccaaggcgaatcagcaaaagcaaatctcaaaaatggtggaatcgctcggttttcttctgagaaacagcatacatatgaaaaaggatatcgtgaccatacaggaggaggcggacattttacgtcactatatgaccattcagcgatttcgatttgaagagcgcctgaatttcacgttggatattgacgatgaggtgaagcattgcctcattccgaaactgacgctccagccgcttgcggaaaatgcgattcaatacgcgcttgaaccctttacaaggccatgcgccatccggattcaggcgaaaaaggcaaaggaatgtgtctgtattacggtcgaagataacggccctggcatggatggacggattcttgaatcaacgggcggaagaggaatcggactttggaatattcgcgagcgcatcagcctgacattcggagagccatacggcttgcggattcatagtgagcatgaaaaggggacgaggattgtgatcacaataccgtgccgaaatgaggtggtgtgatgtataaaatactgctggctgatgatgagaggattatccttgatggaatggcaggaatcattgagtgggagtcgcttggcgcctcattgatcggtaaagcgcagaacggacatgaagcatatgaaaagattgtacataagcagccgcatatcgtcatcacagacgtcaaaatgcccggcatggacgggcttgagttgatcaaaaaggtgtcagccatcagtccgtcggtgcaatttatcgtcctgtccgggtttggagagtttgagtacgcaaaggaagccatgaaatatggggtgaagcattatttgctgaaaccctgcaatgaacagcagattatcagctcgctggaggaaatcattgctgagctgaagcggcaagatgtgcacaaaaagaaaacagcccatctgaaacacgagctggaccatatccgttcctttgcagccgatcaatacttggaaggcttgatcgcaggtgtagcccagttgtctccgccgccttcacttgccggaaaaaagatccgcctcttgatcttaaaaggggaacaatctattgatgccacaaccagagaggcactcggatcggcactgacagcggtttgcagcagcggagaatggacagtgctcgccgtagaggagaacgccgctgaaaaggcggcggaggtttttgcggaccgcaagatggccatcagtcaggcgggagaactccggcacgcggggcagctgtttcgtgacacagctgaagcgtctggtgacctgcatgggagcgcagtgatttcaaaaatgatcaggcttattgccgacgagctcggaaatccgaatctgtccttaaaatgggcggcgaaggatatgctgtttatgaatcctgattatctcgggaagttatttaagcaggaaacaggcgagaaattttcacaatatgttacacgagtgcgtcttgaacatgcgataaaacagatgaaaatgaggcgggatgcgagtgtatcagaaattgctgaagaaatcgggtttggcgataatccgaagtatttcagtcttgtttttaaaaaatataccggtctgacaccgtcagaattcagaagaaaacagggaggcgcttccgcaggatagccatctctgtttttttgactttcgccactgttttttgagtgtttcgccctatccgaacgctttaaaataaaatgtaagcacttacattaaaaggggggattggtttgaagaagatttgttacgttctgttatcgcttgtctgtgtctttattttcagcgggtgttctgtgggcgaagaggcctcggggaaaaaagaagacattacgctcagaatcgcgtggtggggcgggcagccaaggcatgattatacgacaaaggtaattgaactttacgagaaaaagaatccgcacgtccatattgaagcggaatttgcgaactgggatgactactggaaaaagcttgcgcccatgtctgccgccggccagcttcctgatgtcatccaaatggataccgcttacttagcccaatacggaaagaagaaccagctggaggatttaacgccgtatacaaaggatggaacgattgacgtcagctcaatcgacgagaatatgctgtcgggcggaaaaatcgacaataagctttatggatttacgctaggtgtcaacgtgctgtctgtgattgccaatgaagatttgctgaaaaaagccggtgtgtctatcaatcaggaaaactggacgtgggaggattacgagaagctggcgtatgatcttcaggaaaaagccggtgtctacggttccaacggaatgcatccgcctgatattttcttcccttattatttgcgcacaaagggtgagcgcttttataaagaagacggcactggcctcgcgtatcaagatgatcagctgtttgtcgattactttgaacggcagctgaggctggtgaaagcgaaaacgtccccaacacctgatgaaagcgcacagattaaagggatggaagacgattttatcgtcaaaggcaagtcagcgattacatggaactactccaatcaatatttgggctttgcccggctgacagactcgccgctgtctctctatctgccgccggagcaaatgaaggaaaaggcgctgacattgaagccgagtatgctgttttccattccgaaaagctctgagcataaaaaagaggcagcgaaatttattaatttcttcgtgaataatgaggaagcgaaccagctgattaaaggcgagcgaggcgttccagtctccgacaaggtggcggatgcgattaaaccgaagctgaatgaggaagaagccaacatcgtggagtatgtagaaaccgcgtcaaaaaacatcagcaaagccgatccgccagagcctgtgggaagcgcggaggtcatcaagctgctgaaggatacgtcagatcagattctgtatcagaaggtatcgccggaaaaagccgccaaaacgttccgaaaaaaggccaatgagatattagagaggaataattgacgggaatggggctgacgcaatgaaaaaaagccggagtataagaaaagacaatctggcgggatatgcttttatttctccgtttatcatcgggttcctatgctttacggtgatcccgatgggggcgtccctgtttctgtccttcacgagctatgacttgtttacggcgccgaaatggatcgggctcgacaactttaaggaaatgtttacgggtgacgaaaagtattggcagtctctgaaggtgacgtttacgtatgtgcttgccggggttccgctccgtctcggcttcgcgctttttatcgctgtcattttaaacaatgcagcaaaaggaacggccatttacagaacgctcttttatctgccttcgatcatcggcggaagcgtcgccgtggcgattatgtggcgcaatatttttggcaatgacggggtcatcaatgcgctgctgttttttgtcgggattgaccaaaaaattctttggtaccagaatccgacaagtgcgctgtggacattgattctgctgtccgtctggcagttcgggtcgtcaatgctcatttttctggccgggctgaaaaacattccgtcttcgtatttggaagcggcaagtgtggatggggcaaatcgggtgcagcgtttcttcaagatcacgcttccgatcctcacaccgattattttctttaacctagtgatgcagacgatttctgcttttatgacatttacacctgcctatatcatttcgaagggcgagggcgggccgcttgacgggacacttctctattcgctctatttgttccagcgtgcgtttaactattttcaaatgggctacgcatcggcgatggcgtgggtcatgcttgtcattgtcgggctgattacgctcatattgtttaaaacatcgtcatattgggttcattacgagtcaaaggaggaatgacggatggagccggtcaacgagcctgtcagaaaagccccggtttttgaaagaaaaaaagccgggcgcgtcagtcccaaacgcatactgttccatgtttttacagcaacgctggcggtgttactgctgtacccggttatttggctgtttgtcagctcgtttaaagaaagcgccagtatttttacaacctcacattctctcattcccgacccttttattctcagtaactatgctgaagggtggaagggtatcgcgggacagccgtttctgacgtttattaaaaactcggcgatcattgtcggactgtcaacaatcggtgccgtcctgtcatcggctgtcattgcgtatggatttgcgcgtattccgtttaagggaaaaaaattttggtttgcgtgcatgatggggacgttaatgctgcctcatgaagtgttgatgattccgcagtatattatgtttgcgaaattagactggctgaattcctttaaaccaattgtcgttccgcaatttttcgggcatgcgttttttatatttctgatgatccagtttatccggacgattcccgaggagctggatgaagccgcgcgaatcgacggatgcgggcgctttgcctgcttttggcgaatcattctcccgctgattgcccccgcgcttgcgacgtctgcgattttctccttctattggaagtgggaggagctgattcaaccgcttttgtatttgaataagccggagctttaccctgtttcacttgcgctgaagctttttctcgatacagagtcggcttcgaactggggcgcgatgtttgccatgtcggccgtctcgttattgcctgtgattcttgtattctttttgtttcagaaatatatcgttcagggcatcagtacgaccggattaaaataaaaaggagtgttgcagatggcacagcttatctttgatgaagaaaaggtgacgtcggttattgaccggatcgtgaaacggacatttcagatggattttgcgtgggattggccgggcggcgtcgcgttttacggtgtggcggaggcctatgaagcgacggaaaacgaggaatatatcaatctgttaaaaacgtgggtggatgaacagctggaggatgggctgccgccgctttcgatcaacggagtttccattgggcatacgcttttgttcctccacaaggtgacaggtgatgacgtgtatttggaaacagcggccgagatggcggaatatgtgctgcataaggcgccgcgctttggcgagggtatccttcagcatacggtgaatgcggcagaatacgtattccctgaacaggcatgggcggatacgctgatgatggctgggctgtttatgctgagaatcgggcggatcatggagcgtgaggattattttgaagacggtctgcgccagtttcacggacatgaggatgtgcttcaggaccctgtcacgaatttgtactaccacgcctgggacaacaaagcgcaaaatcatctgtcggggatttattggggcagagcgaacggctgggcggcactcacgatggcaaaggcgctcccccttattgaggtgacacatccttcctttatgatcatcgacggatcgctcagagaccagctgagcgcgcttgtccggcttcaggatgaatcagggctgtggcatacgattttggatgatccggattcttatctggaggtttcggcatcagcgggtattgcttctgctctgatgtcgagcggaaagctgtatacaaaatatgtgcagaaatcgcttgccgccattttggatgcggtggaagaggacggacgggtcagcaaggtatcggccgggacagccgtcatgaaaaatgccgaaggatacaaacaggtgccttacaaacgaatacaaggatgggggcagggacttgcgctgacgtttcttgctgatgttttgaaaacgaaaaaacgcgtgtatcagtaaagacagcggcggggggaaagggatgaaaaaacagcctcaacagaaggaacgggtttctcgctggaagggaaggtatttcaaaagaaactttgtcttcattttgctgattgcctgtattcccggattgctgactggcggcgcaatctactttctttcgatcgacaaggtggagaaagagctgcagagatcgcatgaaacacaggtggcgcgtgaggtcagccgaatggatgagaagctgggagtgcttgaactggcactcacccagatggcctacgattcttcactgatgaacggattggccgagagggatttggagaaagactttacgttctcctatcaattaacgaaaaaactgtttcttttgcgggaccagcagccgctgatcgagcaggcttccatctttctgaacagcccccggccacttgtgctgagccctgaatacagcgctttgacagaacaggaggcgcttcgcaagtatcgctcgctacttgcctcagaccacagcatttattggaaacggtcgggaaatcaagcgatgctgatccagctcattccgggcgcggctgagaaaccgttcggcgcgatcatgctggcggttgatccgaaagaaatggaatcaatcctgcaaagcttgtccccctatcctgatggcagtgcgctgcttttagatcaaaatcaagaggtgctgtttcatgaaggggaaaaagattttaaaaagactttacttcaagagataaaaaaacagcctgctgagaaaggtcatattcagatggaatgggaaggcaaggtgtattctgtctcctttggagaaatgaaccggatgcatcagcaatggacctttgtgtcagcggcgcctctttcagctattacagcgccgatggtgtttttatcaaaagtgatcatcgtgatgctggtcatttgcatcggtttggcggtatgcatgacatggtatgcatcaaaaaaaatctatcgtcccattcagcatttgcttggcttgtttaccggtggagagaagaaagtatggcaggcgtccgggcaggatgaattcaagtggattgaaaagagatggcaggatctatcccttgaaagccggaagctccaagagcagctcctgcggcagacgccccatatgaaaaagagttttttgcagcacctcttgcagggggatttttactatgacaacgaggacagtctcagatctcggatggaggaggccggctggaacatcggcgaaaacgtgtttcatgtgctggatcttcaattgacaggactccgctgtgaaaaaagcatcttctgttgcgatgatgaacagctcgctgtgtttacactgactaatatcgctgaggaattggcggataaacgcgtttttcagctctccatacttgatatcggccggctttctgtcaccgttcttgtgatgaaaacaaacagctctgatctgaaggcgtatataacggagctggcacgccaatttggagatgtaaccggactatgcctgacctcgacattgagcagcaagacggagcgtgtcacggaaattccttctttatttcaggatgtgaaatgcggcaaatcccgcaggaagtttgctaaccgggatcaggtcattgatttgcaggccgacttccctcaggatgagcagttcgctccttattacccttttgagctggaaaaacaaattgttcaggccatccggctggaaagaaaacaggaagccgaggaactgatagatggatgtatgagggaactggcggaaaaggcggccatagacaggcatgtgcattccgccctgattcagctgttttcccgcattcaggaggatattttgcattccgggctcaatcctagcgaactgtttcagcatcggaacccgtttcttgatatttcagaattgcgcgaacctaatgaagcggcggcctggctgatggatgtagtggtgacgccttacctttccaagcttgagggcagaaaaaacagacagcaaaagcagctggcagaacgtgtgattgcgatgattcacgaacagtatatggcggatatttcattggaaagctgtgccgatgcgcttggcatgaattcatatacgttaagcaaggcatttaagcaagtgaccggcattaattttatcgattatgtgacccagatcagaatcgaaaaggcgaaagaattgctggtcaatacgaataaaaaaattcatgacgtgtcagaagaagtcggttaccgccacaattactttaaccggatttttaaaaaacaggtcggcatgccgccgggtgtcttcaggcaaatgtatcaggaaacgccgtgaaaggagagaacatgtgatgaagaaaccgattcaagtatttttagcgggagattccactgtgagtgactgcccgcctcatgaagcgccgatggcggggtgggggcaggtattcgggcaattgttttctgaagaggtagtggtgcacaatcatgccaaaggaggagcgagcaccaattcttttgtggaggaaggaaggcttcaagcaattgccgaacgcatcacacaaggcgattatctgttgattcaattcggccacaatgaccaaaaaccgcgggggacgaagccgtactccacgtttcagcaatttctcaccctgtttgcagatacggcacgcgaaaagggcgcgcatcctgtgttcgtcacatcggtgcagcgccgccgcttcgatgaaaacggacgaatcgagcattccctcggtgagtatcccgatgcgatgaaagcactggcgaaggagctcgatgtacctgtgattgatctgcttgcgaaaacaaaggtgctgtatgaagcatacgggccggaggagtcgaagcgattgttcgtttggtttcagccgaatgaacatccgaattacccggacggcattgaggacaatacgcatttttcggaagaaggtgcaatggaggttgcgaagcttgtggcagaaggccttgaagagatcggacttccgcttaaggaccaccttgtgagccgggagggaaaagaacatgtataaggaaggcacttgcttgtaccgcaatccgctccggtctaaaagcgatgtgaaggactggcggatggagggaggcgggcagatctcatttgacgatcacagcttgcacctgtcacatgtccaggatgaagcgcactttgtcttttggtgtccggaaacctttccagacggcatcattgtgacatgggatttctctccgattgagcagcctggactgtgtatgctgtttttttctgctgcgggaatgggaggcgaggatttgtttgatccaagtctccagaaaagaacgggaaaataccccgagtatcattcgggggacatcaatgcgctccacctgtcgtatttccgcagaaaatacgcggaggaaagagcgttccgcacctgcaatttaagaaaaagccgcggtttccacctcgccgcaatgggggccgatccgctgccttctccagacgacgctgattctccgtatcgtatgaagctgatcaaagacaaaggctatgtgcacttttcaatcaatggtctgcccattcttgagtggatggacgacggcagcacatatgggcctgtgttaacaaaaggaaaaatcgggttccggcagatggcccccatgaaagcagcttacagggattttgtcgtgcatcaagcggtgagaagatgaagacgactgtaacggatgcgctttatgcaggctgcgaagcggtggtgaaaatagcatggctcaacgggctgtggctgttgtttacacttttgggcggcgttcttttcggatgggcgccgagcacagccgcgatgtgtgccgttataaggaaatggctgatggggcaaaaggatgtcccgatatttccgttatttctcgatacctataaaaaagagtttctcaaggttaatgcgatcggattggcgttttgggctcttttgctcatattgtccgcgaactatcattatttttctgccagtacggattggctgtcctttgccgtaacaagctgcacgctgcttgcagggcttttgtatatcatcgcgctgatgtatgtgtttcccctttatgtgcattaccagctcccgcttcgcaaatatataccgcaggcactgctatttggcgccatgaggccgctgacaactggctgtatgctgatcgggtgcggatttgtcctttatttgctttatacgcttcctggcctgatcccattttacggcccgtgtttatttgggcttgtgttgatgttttttgctcttaggggatttcaaaagacggaggcccagcaccatcaagccgggtaacaaaaaaatgacaaatacgcaaaaaagtgcagtgtccgaaataggcagatgcaaaaaagtgaaattgaagacagctcacacagcgcataaaatccaatttaagtaagcgcttacaaataaatgagaaggagctgtctgatgattacacgaaggaaacgcatgtttaccgctgttacgttgctggtcttgttggtgatgggaacctctgtatgtcctgtgaaagctgaaggggcagcgcggcagatggaagcgctgaaccgggggcttgtagcggtcaagacggacgggggcatttttgtcagctggcggtttcttggaactgaaaacgcatctgttttgttcaatgtgtacagagacgggcaaaaactgaatgctgcgcctgtcaaaaccacgaactatgtggataaaaacggttcggcgggctcaacgtatacggttcgggctgttgtaaacggtaccgaacagccggcttctgaaaaagcctccgtatgggcgcagccgtatcattccgtcccgctggataaaccggctggcggcacgacgccaaagggtgaagcttacacgtacagcgctaatgacgcaagtgttggcgatgtggatggtgacgggcaatacgagctgattctgaaatgggacccgtctaactcaaaagacaattcacaggatggctatacgggtgacgtgctggttgacgcgtataaactggatggcacaaagttatggcggatcaatctcggcaaaaacatcagagcgggcgcgcactacacccagtttatggtgtatgaccttgatggtgacggaaaagcggaagtggcaatgaaaacggcagacgggacaaaagacggcacgggaaaagtaattggaaatgccaatgctgattacagaaatgaacaggggcgtgtgctttcaggccctgaatatctcactgtgtttcaaggttcaaccgggaaagagcttgtcaccgcaaattttgaaccggcgcgcggcaatgtgtcggattggggagacagctacggcaaccgtgttgaccgttttctcgccggcattgcctaccttgatggacagcggccgagcctgatcatgaccagagggtattacgctaaaaccatgctagttgcctataacttcagggatggaaagctgtcaaagctttggacgctggactcctcaaagtcaggaaatgaagcgtttgccggacaggggaatcacaacctgagcatcgcggacgttgacggggatggaaaagatgagattattttcggctcaatggctgttgatcatgacgggaaaggcatgtactcgaccggcttaggccatggggatgccctccatacaggagatcttgatccgggccggccggggcttgaggtgtttcaagttcatgaggacaaaaatgcaaaatacggcttatctttccgggatgctgcaaccggaaaaatcctttggggcgtttatgccggcaaggatgtaggccggggaatggctgctgatattgacccgcgttatccgggacaggaagtgtgggcaaacggttctctctactcagcgaaaggagtcaaaatcggaagcggggctccgtcctcgaccaacttcggcatctggtgggacggcgatctgctgcgggaacagctggacagcaaccgaattgataagtgggattatcaaaacggcgtatcgaaaaatgtgctgactgcatcaggcgcagcggctaacaacggcacaaaagcaacaccaacgcttcaggctgatctgctcggtgactggcgcgaggaagtggtgtggagaacggaggacagcagtgcactgcgcatttacacgacgaccattccgactgagcacaggctgtatacgctgatacacgatccggtgtaccggcttggcatcgcctggcaaaatgtcgcctataaccagccgccgcacacaagcttctttttaggagacggcatggcggaacagccaaaaccaaatatgtatacgccttaactgaaagggggaaggaacgggctgcgcgcagcccgttcccattaaaatgaaaccaaaaaagaggcaaatggaatacctgaccagaggtttgattgcggtaaagacagaacagggcgtgtttgtcagctggcgttttctcggcacggatcatgagacgacggcttttcacctttatcgggatggaaagcggatcacccgcgatccaatcgatgaaagcactaattttctcgatcaaaatggaacggctgactctgtttatcaagtggcggctgtcaataaaggacgggaagaaaagctttccaaggaagctcgtgtttggcaggaaaatgtcctggaggttccgcttgccaaaccggaaggcggtgtggcgccggacggaaagccgtacacttacagcgccaatgatgccagtgtcggggatatagacggggatggagaatatgaaatgatcctgaagtgggacccatccaattcaaaagacaacgctcatgacggttataccggggaggtgctcatagatgcctataaactggacggcacctttttgtggcgcatcaacctcggcagaaacatcagagcgggcgctcattacacgcaatttatggtgtatgaccttgacggtgacggaaaagcagaaatcgccatgaaaacagctgacggcacaacagacgggaaaggacatatcatcggtgatgagcatgccgattttagaaatgaacagggaaggattctgtccggaccggaatatttgacggtgtttaaaggagaaaccggtgaggcgctcacgaccgtggaatatgaaccgccccgcggcaaactggaggattggggagacggctatggaaatcggatggaccgttttctcgccgggatcgcttatttggatggggagcggccgagcctcgtgatggcgcggggctattatacgagagccgttctcgtagcatacgatttcagaaacggaaggctcaaaaaacgctggctatttgactccaaccagcagggccatgaagcgtacgcaggacaggggaaccacagcttgagcgtggcagacgttgacggagacggaaaagatgaaatcatatacggcgcaatggctgtcgatcatgacggaaccggcctgtactcaacggggctcgggcacggagacgcgatgcatgtaggggatctggacccgtcacgaaaagggcttgaagtgtttcaggtgcatgaggacgccacgaagccgtacggactgtcactgcgagatgccggaaccggtgagatattatggggcgtccatgctggaactgacgttggccggggcatggcagctcatattgatccaagctacaaagggtcgctcgtctggggaattgatccgccgggcaatgatggcatgtcgtatgggcttttcacgagcaaaggcgaaaaaatcagcgacaaagcgcccgcttcagccaatttcgccatctggtgggacggtgatttggtcagagaactgcttgatcatgactgggacggaacgattggcaggccaaagattgaaaaatgggatgctgaaaacggctgtctgaagacgatatttcagccggccggcgtgctgtccaacaacggcacgaaaggaaacccggttcttcaggccaacctgttcggagactggcgggaagaagtgatatggagaacggaagacagcagcgcgctccgtatctatacaacgacacatctcacccgccaccgcttttacacgctgatgcatgatccggtttacaggctcggcatcgcctggcagaataccgcctacaaccagccgccgcacacgagcttttacctcggaacgggaatgaaaaaaccgccgaagcccgccctgtacatagcgggaagtaaagcggaggcgccgctgtaggaggactaagggataagacgcaaaggctgaacgctacgacaagatgattaacgaacgggcaggacgaaccaatgctcaagcgctgtacgcaccggtctttttcaagggaagagctatccgtgatggaagctgtataaaaaacgaggaggaatgaaaaaatggcaaatcatatttatcttgccggcgattcgactgttcaaacgtatggagacagcacaaatcaagggggctgggggcagtttctcggctcgcatctgccggagcatattcaagtgatcaacagagcgatcgggggaagaagctcgaaaacatttgtggaagagggcaggcttcaggcaatcctcgatgtgattgagccggatgattggctgttcgtgcagatgggccataatgacgcgtcaaaaaataagccggagcgctacaccgagccctatactacttataaacaatatttaaagcagtatatcgcaggcgcgcgggaaaaaggcgcccatccgcttctcattacccccgtagcccgctttcattacgaaaacggcgtgtttttgaacgattttcctgattactgcattgccatgaagcagacggctgaagaggagaatgtccagctcattgatctgatggagaaaagtctcgctttctttactgagaagggcgaggaaaaagtgtacacctattttatgatttcagaagggattaacgattacacgcattttacaaaaaaaggcgcaaatgaaatggcgaaacttgtggcaaaaggcataaaggagctcggcctgccattgacagaatcgatcatcaaagaaaggtgaaaatgggatgagaaaactgtatcatggcgcttgctattatccggaattatgggatgaagagacgattcagcaggacattgacatcatgcgtgaagttggcgtaaatgttgtgcggatcggcgaatttgcctggtctgtcatggaacctgaagaaggaaaaattgacgtcggttttttcaaagaaatcatcgcccggctgtatgatagcgggatcgaaacgattatgtgcacgccgacgcctaccccgccgatttggttctcacatggccggcccgaacgcatgcatgccaatgaaaaaagagagatcatggggcatggctcccgtcagcatgcctgtacgaacaacccgtatttccgaaaaaaagccgccatcatcaccacagccatcgccaaggagcttggccggctcccggggctgatcggatggcagctagacaatgagtttaaatgccatgttgcagaatgcatgtgtgagacatgcttgcgcctatggcatgactggctcaaaaatcgctacggggtaattgagcgcttgaatgaagcttggggaaccgatgtgtggagcgagacctatcagacgtttgagcaagtcccgcagccgggaccggccccgtttctgcatcatgcctctctacgcactatgtatcagctgttttcgatggagatgatcgcttcgtttgcggatgaacaggccaaaatcatccgctgctattcagatgcgccgatcacgcataacggatcagtcatgttcagcgtggacaatgagcgaatgtttcagaatctggattttgcctcctatgacacgtacgcttcgcaggaaaacgcctctgcctttttattgaactgtgatttatggagaaatctgaaacaagggcgcccgttttggattttggaaacgagtccgtcgtatgccgcctcgcttgaaagctccgcttacccgcacgcagacgggtatttgcaggccgaagccgtatcgtcctacgccttagggagccaggggttttgctactggctatggcgacagcaacgttcaggcagcgagatttcccacggttcggttctcagtgcctggggcgaacccaccatcggctatcaaaaggtgctggcggttgagcgggcaagaaaggaaatcgagcctattattctatcgactgaacccgttcaagccgaggcggcgatgacttactctgacagagcaaaagcatttattaaaactgagcctcaccggggactccggcatcgttcgcttgtgacgcatttttatgaacgtattctcaacacggggattcaccgtgaccttattccggaaggcgctccactggacggctatcgcttgctgtttacgccatttgtgccgtatttgtcttctgaatttatcaaaaaagcttcggcattcgctgaagcgggcggcatctggatcaccgggccgctgacaggagggcgcacatgcgagcataccattcataccgattgcggacttggcgaacttgagaaaacgtcagggatcaaaacactttttacctttccgatgaatgagaacgtgaatacaggaaaagcgtttggcatcacggcgccactcggactatggagcgcggtgtttgacacagagagcggaaacacccttggcacggttgaatcaggaccgggggcgggccatgcttttctgacggaacagaattacggcgaggggaaaattgtcatgctgggatcgcttccatccgggaaagaaggggatgcgatgctggaagcgctcgtcaggcattatgcggaggaagctgttatttccagccggtcggatgtgacgcccggcacgatcgttgccccgcgcaaaggcgaaaacggccttgtgtggatcgttgtgaatatggatggaaaaggaggaagtgtgacactgccggaagcgggaacagatctgttgacgcaccgcttggaaaaggcggggaggctggcggtcggaccgcatgaataccgtgtgattcaatttgacaatcacagctgattctttgcatcgaatcagcttttttctatggagggagagaccgatgaaaaagatcaaatggttatcaggacagccaaaggtgataagtggtgtgacgtggggcgtgccatggaaaaaaggagaattaaaaaagggtgaccgtctggcgcttatgaatgaaaacgcggaaatgcgatatgtgcaaagcgaaccgttggcctattggccggatgggagcatcaagtggacgaagcacgcggcggtgtttggtggtcagagaaaccaaatatttacagttcgcaaaagagaagtgccgcagccaactgaatcgctcagcattcatgagacagagcatgatatccaagtgaatacaggagcactcgtttgtaccattcataaaaaaggatctgatttcattcaatcattgcagatcaatggaaagccgatcgccgcaggcgggaggctcgttgcgataagagaaacgagaaaggagtcggcggcggaaacggttcttttgcatgaaaggtctgtcagctttatcaaacgggcggcgattgagcagagtggtcctgtcaaagcagtagtcaaaatcgagggagtgcatgtgctccataaaacgtatgaggaatggctgccgtttgtcatccgattaacgttttatgccgggctgtctgagatcggccttgtgcacacgcagctgattgacaggagcggtaaacaagaattcataaaggggctcggcatcgaattcgacctttttttggagggagagccgtacaaccgccatttccgctttgcgggagagaaagggatgtacaaagaacccgcccagctgtttggcacacgtaaattcaatgaacgatatccgctttatgaaaaacaaatcaatggcgaaatgctgtctccagatgaagagcataaggaatggtttgcacatggcacacagaatgtggtttgggacgatgtcaagcttgtgcaagattccagcgatcattacagcctgtcaaaacggaccggaaaagattatgcgtgggttggaatgctgcatggcagccgggcgaaggggctctgctatgcgggcggaaaaaatggcggtgtggctctcggcctgcggtatttctttgagaaatatccttcagcactggaaatcacaggtcttgccggcagccgccccaaaatgactatctggctttggcctccggacggcgaagcgatggatttgcggcattatacaggaaacacccacgtggccagcgcgtatgaaggatttgatgaaatgcgctctgatccgacaggcattgcgaacacaaatgaaatcagcctggcgtgcttttcgcacatgccgtctgacgaagtccttaatgcactcgctgacaaatggcaggcgccgccgctcttgatatgtgagccaaacgtctattacgaatcaaaagcgctcggggtttggagcatcattgacacatcccatccgctcaaaaaagagctggaggaacagcttgacgccgcctttctgttttataaaaaggaagtagagcagcgcaaatggtacggtttttggcattatggcgatgtcatgcatacgtatgacccgatccggcatatgtggcggtacgatctcggcggatacgcatggcaaaacaatgagctcgttccgaccttatggctgtggcaggcgtttttccgctcaggcagagaggatatctttcgcatggcagaagccatgacccgccatacgagcgaaacggacagctttcacctcggtgaatacgcaggacttggttcacggcataacgttgtgcactgggggtgcggctgcaaggaagcgagaatcagcatggccgggctttataaattctattattatctgacgggtgatgagcggacgggagatcttttgacagaagtgaaggatgccgattatgccctcgtcaaaaccgatccgatgcgcgctttttacgagaaaggcaagcacccgactcacgccagaacgggaccggactgggcggcgttttgctcgaattggctggcggaatgggagcggaccgaaaatccggaatatctccacaaaatccaaacgggaatcaactgtctgaagcggctgccgctccgcttattatccggcccgacatttgaatatgacccggcgacctcgatgcttcatcacatgggagacggcattgcgggcggatatcatatgatcattgccttcggcgcgccgcaagtgtggatggagctggctgagcttcttgatgaccgggaatgggaggatatgctgagtgaattcggcgaattttacacactcagtgatgaggaaaaacgaaaaaaaagcggaggcgctcttcatgacgggcattttcactggccgatgttcgccgccagtatgacagcctacgccgcaagaaaaaaacaagatcctcatctcgccgccaaagcgtggaatcttttgctagaagataagctcagccatacgccgcttccgatcaaaccggagcgcatcgagacatggacgcagctagaggagcttccatgggtgacaacgaacactgtctctcaatggtgtttaaatgtcatagcggcgctggaactgatcggagattcccttccggcaaaaaaagaaacatcgggcaaaaaaggataacagccggaatttcataggagaaatggtgcaaaaaatgaagattgcaagaatttatgtaagcgctttatattgagaggggcaaaggggaaatgcaaattgaaaaaagggggacttacgcaacatgaaaataagaatgcgaaagaaatggatggccttgccgcttgctgccatgatgatcgccggatgcagccattcggaaacatccaattcagcaagcggttcgaaagatacgatcaaaattatggcgccgcttttatcgccggaaagcccgagtgataagagcccttcattaaaagcactcgaaaaatacacaggcaaagagattaaggtcacatgggtgcctgattcatcctacaacgacaaattcaacatcgtcatggcttcaggagagatgcctcacgcgattgtcattaaagataagtcagccggctttatcaaatctgtcaaagcaggggcgttttgggagctgtctccttatttaaaagactacaagaatttaagccaggcagatgaaaagattttgaagaacagctcggtgaacggcgaggtgtacggaatctacagaacgagggatctgatcagggcgtgtatgatcatcagaaccgactggctgaaaaatgtcggtctgaatatgccggaaacgcttgatgatttctatgaagtgctgaaagcctttaaggaaaaagatcctgacggaaacggcaaggatgatacgtacggcatggtcgtgccgaaatggatgggactcggcaacggaagcccatgggatgttctgcaaatctggttcggcgctccgaaccgctacggtgttgaaaacggaaagctgattccggattttacaacgaaggaatacatggatgcgctcacgttttttaaaaagctctatgatgagggattgatcaataaggactttgctgtcatggattctgcgaagtggaatgatccggttgtaaaaggaaaagcgggtgtcatcgttgatacaggctcaagagcgtctcaaatccaaagcgcgatggaggaggcggatgagtcgaacaaggatatcattgatatcgtcggctcgcttgagggaccgaatggcaagcgcaccttcccgacatctggttattcaggcatgatcgcgataccaaaatcaagcgtcaaaaccgaaaaagagctgaaagaggtgctgtccttcctcgataagatgaatgataaggaagcgcagattctcacgaacaacggagtgaagggccgcaattacgagctcaaggacggcgtattcacctcacttgaaaaaaacaacaaatctctcctgtatgagcatgaaggcttggcacagttcagcatgtcgattccaaaaagcgagtattacatcgaagaccagaaaaccaagctcttccagcatcgcaaggacatcataaccgaaggagaaaaaatagccgtctttaacccggctgagtcgcttgtatctgatgtctatacccaaaaaggagcccagcttgacaacatcatcctcgacgcgagaacacaatttatcattggagaaattgatgaaaaagggttcgatgatgcggtggagctttggaaaaaaagcggcggcaatgaactgatgaaggacttgaacaaattgtaccaatcgtcaaaataaaccgatgcgcctgccgttcggcgggcgccccggtatcacgaaaggagaacagatatggaaacagtgccgaagaagggagatgcacctgttctcaccgctggaaaaggcatcagctggatggctgcgctcaaacgggacaaatggctttatcttcttcttattcccggtctgctttatttcttgattttcaaatacttgccgatgtggggtgtgctgatcgcttttaaagactattcgccatatctcggcttctggaaaagcgaatgggtcggctttgattatttcaaagacttttttatgaatccggattttttccggctgctgcgcaacaccctcatgctggcgagtctggatcttttgtttgcctttcccgcgcctctcattttggccctgcttttgaatgaggtaagaaaggctgtgtataaaagatgtatccaaacctttatttacgtaccccattttgtatcatggacaattgtggtcagcatcaccttcgttttttttactgtcgatacaggtgtgatcaacaaaatgatcatgagcctgacaggtgagcagatttctttcttgtcggatgcagactggttccggccgatgattgtgatgcaaagcatttggaaagagacaggctggggaacgattctatttttggcagcgcttgctacggttgatcaagagcagtatgaagcggccatcatggacggagcggggcggttcaggagaatgtggcatattacgctgccggcgataagaagcaccattatcgttttgttgattttaagaatcggcagctttttgaatcttggctttgaacaggtgtatttgatgacgaactcactcaaccgcagtgtggctgacatcttcgacacgtatgtgtacatgatggggattacccaaggggcgtatagctacagcacggcggtcggtttgtttaaatcagttgtcgggattatcttgatttttggcgccaattacattgcgaaaaagtttgatcaggaaggattgttttagaggagggagaggtatggctgaaattcacacgatgcacaacaccaaagccggacgggtgtttgacgtctgcaacattctgtttctcggcggtgtcggcgcgattaccattttgccgtttttatatattatcgccggttcctttgcgacagaagcggaacttgcccagcggagcttctttattttcccgaaaacctttacacttgatgcttacaagtatgtgttttcgacaccgacgttccttcgaagcatgggcgtgtccatcttcatcacggtggttgggacggctgtacagctatttttcaccttcacgatggcgtatccgctggcgaagcggcatgtgaagggacggaatctgctgttgaatctggtgattttctccatgctgttttcaggcggcatgattccgacgtaccttgtcgtaaaatcacttggccttttggatacgtattgggcattgattctgccgatggcgattaatccgttcaaccttattattatcaaaaacttctttcagcagctgccgcgcgagctggaggaatcagcaaaaattgacggctgttccgaaatcggcgtcttctggcggatcgccctgccactgtcaaagccggttatagcgacctttgcgctgttttatgcggtcgggatttggaatgatttcttccacgctctcttatatatcaatgacagtgcaaaatggccgctgcaaatggtgcttcgccaagtcacgattttatcggatttaacggcgaccaatggcgatacgatgcaaaatgccgttccgccggagcagggaattaaactcgctgtcattgtcattgcaacgctgccgattttggcggtctatccatttttacaaaaacactttgcaaagtggatgctgatcggttcggtgaaaggctgagaaagggagtgtttcatatcagtacattagatcggattaagattgcctatatcggcggggggtcccaaggctgggccagaagcctgatgagtgatttgtcgattgatgaacggatgtcaggcacggtggcgctctatgatcttgattttgaagccgctcagaaaaatgaagtgatcggcaatcacagcgggaacggcagatggagatatgaggctgtttctactttgaaaaaggcgttatcagccgcggatatcgtcattatttccattttgccgggatcactggatgatatggaagtcgatgtccacttgcctgagcgctgcggtatttatcagtctgtaggtgatactgtcgggcctggagggatcatcaggggcttgcgtgctgtgccgatatttgcggaaattgcccgggcaataagagactacgcacctgaatcatgggtcattaattatacaaacccgatgtctgtctgtacaagagtgctgtataaagtgtttcccggcatcaaagcgattggctgctgccacgaggtattcgggacgcaaaagttattggcggaaatggtcacggaaaggctggggattgaggtgccgcggcgtgaggatatccgcgttaatgtgctcggcattaaccattttacatggatcacaaaagcctcttaccgccatattgacctgctgcctatattccgtgaattcagcgcgcactatggggaatcaggaggatatgagctggagggggaaagctggagggacagcgtcttttgttcggcacaccgtgttgcgtttgatttatttgaaacgtatggcgccatccctgctgcgggagacaggcatctggcagagtttcttcccggcccatacctcaaacagcctgaagtatggaaatttcatctcacacctatatcattcagaaaacaagacagagctgagaaacgacaagaaacagaacggttgatcgtgcaacaacgaggcgttgctgagaaagcttcgggagaagaaggcgtgaatatcatagtggctcttctcggattgggtgaactcgtcacaaatgtaaatatgccgaatcaaggccaggtctcaaaccttcctatacaagccattgtcgaaacaaacgcattcatcacaaggaaccgtgtccagccgattttgtccggagcgcttccgaaaggtgtggaaatgctggcggctaggcatatatccaatcaggaggcagtggcggaagcaggtttaacaaaggacactggcctcgcgtttcaagccttcctcaatgacccgcttgtcaagattgaccgcagtgatgcagagcagcttttcaatgacatgctccaatgcatcatgcaacgttgagcggagtttttccggtttagaaaggaaagcattgaccatactgatagtattatcaagaagtaggtgctatcaatatgggaaattatttaagcgttgcggtagaactggtctgcggtttaggcattttatttatcatcttaaagcttctcgggaaaacccaattttctcaaattacgccgtttgactttatctctgctttaattttaggagaattagtcggaaatgccgtttacgatcatgaaatcaaaatcaaagaaattatttttgcttcgctattgtggggcgtgctgatttatattattgaatttatcacgcaaaaaatgaaatcatcgcgaaagttcttggagggcgagccgaatatcgtcatccgcaaaggggagcttcaatataaagtattgaagaaaaataagatggacattaaccagctgcaaagccttttgaggcaagcggggagcttttcgattcaagaagtagaatatgcgattttggaaacaaacgggatggtcagtgtgcttccaaaatccgactttgacaaaccgaccaataaggatttgcaggttccttcgaagtctgtttccctgccaatcacgttaatcatagatggagagcttgtccgggataatctgaaggaagcaggtgtggatgaacagtggctgaagcaagaattgaaaaagaagaacattgataagacggaggacgtgttatttgcagaatggcataaaaataagccgctgtataccgtaacatacgaacaaagcagatcaacatgactcttagaaaaaagcttgcagcaaggcgcaagctttttattgattgtatgtcccttgtttgacagcacgtacatggtacatgctcacttcagtgctgatcagatagtcaggctttggtttgcctttgtttgctttgtggccggcgatatgcgcatcgcttttttcccattgcttccagcgatcctctgattcccagcgaatcatgacaacaacttcctcatcaccgcggcgtacgtttttctcaagcactgtcacatcaattaaaccttcttgtttttcaatgattccttcagcgctgaaacgttctatgactttatctgcaaagccttcttttaccgtcatttttctcaactgaacaaacattcgtctcactccaatcattctcacatatgaataattgtaaatgaaattcattctcattgtcaaagaaagcgcagggcggaatcgaaccgccgtgcgcaacagtttattcttttaataaaaacacatttccgtcttcgtccttaaattgaacgaaggtgccccactccatttgattgggctcaccgagaaattctacaccgtttgtcttcattttctcgtatgtaccaaagatgtcttcgcattcaaacacaatagaagccttcatttgctctgagcctttcatcatggctttcgggtaaatgactaaacgagtctcggctccttttggcgcaacctccagccagcttgcttcaggtcccattgggtggtccgctgcaatatcaaagcctaccttctctgtccaaaattgcttcgctttctgctggtcctcgacatatacagcaacagtgccaatttgtttgatcatagggaaacctccaagttgaaaagataataatactataacctgtttacggccgaagtaacataaaaaaatcagccgggaaaccggctgatttttaaaatgagcagctgacaacatcgatgtgatttgtgtctaaggcgaaataaacccagcggcgccgtgaggaatcccaataaaagccgccgacggatcttctgccaaggatgatcgggtaaaaccaaaatgagcggccattggttaaccaaacataggtaaatcggaaaaggcaaggacgaatggtgattggttcaactaacaaaacggctccttgagaaccctgcggttttgggggtttcgctggtatttgggaaggaggaggtccctgcggcgcaccgccgaagcctgggctggcaccgctgccaataccagggccggagccgccgccaaaacctggaacagcgccaccgccaataccagggccggagccgccgccagagcccggaacagcaccgctgccaatgccaggccatggatatcggtattcatattcaaaagcaggccaaggctcataaaaatgccccgcaaacatataaggatcaacataatacatgtgataacgtcctttctcattgtaaactgtacactgcagtttatgcgggcggactcttattggtgcattcgcctaaggatatgaagctggaatgctctcaaagagcagaatcatttgatttttctctagtcttattcacaattccgatttatcattttataatgaaagtgcttctattacgaaaaaggagacagaccgtgaatatcgatcaattattatatcaatatatcatagacaacactgcggatattactgagaaatggttcagtttgcgttgccagctaaaaggcgagctatattccgccagccatttaagtgaagaaacgaaaacacttttaaccgagcagcatacatttaccaatataacaatcgcaagcgcatttctggaggatcaaaccgattttcaagacaacatgacaaaatgggcggaaaacgttgcgaaaaacagggtagagcaggatgttcaagttcatgaggtcgtagaagccatatccaactctagaatctcattctgggacgcagtcgccacatttataaaagagaatcaggagatcgtgacaaatgaggatgcagaccgatggaaccgcattgtgaatcagtcgttcgataagctgattattgaattctctgagcagtaccaaaaattcatgctgatgaggctcacatctcagcaggaactgatctcagagcttggctgcccggtcatttccattgccgatggaatcgggatattgccgcttatcggctccattgatacaaaacgggcacaggtcattttagaaacagtgccggtccgctgtgtcgagagaaaaatcacaagcctcgtcgttgatctttcgggtgttccgattgtggataccatggtggctcagcaattgtacaacctgtctaaaacgcttttcttattaggcgtcaaagccgtattttcagggattcgcccggatgtggcccaaacatcgattcaattggggcttgattttagtgaatatgaaacgtacggcacgctgaagcaggcattagaaaatatgggtgtccgctgtattgttgaggaattggaagaaaacaaataggaagtttccaggcatatgattgtccgtcaccgggtgatcatatgcctttttgatttgaacagaaatcaccattgatttatcaaaaaaaacataatattataattcttataagaatactgtgaattaaaacctattcaacagggggaaggtcttttggtttcaaaatcaacgattgatccggaagtgattgaaaaaatcatcagctcgctggaaacactcgatttcggcaccgttcaaattacggttcatgattctcagattacccaaattgagaaaatagaaaagcaccgtttttcgctgaaaaggaaagaatcaaaatgataatgtaaagggcgtttgttttcattaaattctccttaaaacatatacatatttcatccaatttttatataatagacctttaagatcattttttaggaggatttttgacatgcaagctacggttcacgagagtaagcaatcgatcatgcaacgcattttgacagtctttgtctttactttgctgatcgcgactgtcggcctttttatcggccaatttgttcctgtcgctttgatgctgccgctttctattcttgaagtggtgatgattattctggccttctggatgcgcagaagaaaagcggtcgggtatgcgtttgtatatacattcgcgttcgtttccggcattaccttatttccgatcgtcagccattacgcttccatcgccggcgcctatgtcgtgcttgaagcctttggttctacatttgtcatttttgccgtcttaggcacaatcggcgcaaaaatgaagaaggatttatccttcctgtggtcatttctgctggttgcggtgctcgccctcgcagtggtagggattttcaacattttcagcccgttaaactcagcggcgatgatggcgtattccgtgatcggaaccatcgtcttttccctttacattttgtatgatttgaaccaaatcaagcaccgccacattacggaagacttgattccggttatggcgttatcgctgtacctagactttatcaacttgttcatcaacctgctccgcttcttcggcattttgagcagtgatgattaatgaaaaagcgtctgtcattggataggcgctttttgccatacatcaaaaaggcaggtggagtattggtgaaaaaacaaatgggcgcatatgtatctctggcagcagctatggcgatcgtcggcagttctgtcgttgtcggcaagctgatggtcgaacggattccggtctttctttcctcaggattgcgttttttgatcgcttctgtcgtattgctcatgctgctgttttgcattgaaaaagggtttccggctttgacgaaaaaagatgtgttcgtattactggtgcaatcattcacaggcgtgtttttgttcagtatttgcctgctgtatggggttcaatatacgacgggaacggaaagcggcattttgacaagcacaacccccatggtgatcggtattttatcctttttcctgcttagagaaaaaattgagaaaaagacgctgatcggcattttgctggcggtttgcggcgtaatggcgattaatttgtttggagccgggagccaagacgggacgccgcacgccttattcgggaacatgctgatcattgctgcagtcattggcgaagcgttgtttacattgatggccaagctgctatccccgcatatttcggcactggcgatttcgaccttcgtatcgctcttcggcttcctgttttttctcccgtttgctttgtttgaggcctcttcatttgattacagcgtgccgactgttttggattggtcgtatgtgctgtattacgcgctttttgtcactgttttggcgttttacttatggtatagcggggtgacgaaggtgccggcgggtgtatcgggcattttcacatccgttcttccggtctccgctgtcattttgtcaggcgtgatattgaaggagccatttgagtttgtgcatttcatcggcattgcatgtgtcatcggcggcatatttgttacggtcataaagaaaaaacagccggatgcgtatccggctgcagaagaaaagacgctatagcctgtccggatcggacgggttttttagtctttaaacacgctcagcctttcaaaaagatcaccaagcatcttcacgaacatgtctttttcctcgtcgctgtagttttccatgacagcggatattttgctgaaatggccgggcagaaattgctccaggcgtgctttgccttctgttgtcagttcaatgctgatttttcgtttatcctctgtgtgatgcctgcggctgacaaaaccgtctctcgccagcccgtccagcaggcctgtaatcgtcgctttcgtgacgtttgactgtttggcaagctctgtcggacttaacctatgatccttggcatcaaagagcagcatcagtattttgaattttccttctgacagccctcggccagcaaagtaatgctccatcacatgattcattttttttgaaatatcaaaaagagataaaaacaattcaagagagccggcgtcaatattggaatacgtttcggcgtgctctgttatatgcttatatttcggtaaatgttttaattccatcgcaagtagctcccgtacattcgttgtgacacgattataaaggagggaaaaccataacgcaacttggcttggagatgattgacagcttttcttgggacatagtaaggtaatatagttaggcgcctaactaatacatatagagctgaaaaggtggttattgatatgaaacatatgttaattgcaggaggcggcatcggcggcttgtcagcggccatttctctccgtaaggcagggttttccgtcaccttatgtgaagcggcttcagaaaaccgaaaaacaggtgcggggattcttcagccgcaaaacgcactggcggtgttgaaagaactgggcgtattcgaagagtgctgtaagcacggctttcaaacagaatggtttaaaacgtttgatgaacaggggaatttgctgtttcaagtcagtgaatcctttttagacgattcacttccgggacgcaataatatcctgcgcaaaacgttaaatgacattctcatgaagcatgccgaggcagtgggtgtagacatcaagtgggggaaaaaggttgtcgcttatcaagaaacagctgaatcggtcactgccgtatgtgaagatggagaaaaaatgcaggctgccattctggcgggctttgacggcattcactccgttgttcgcgatataatgctgcaaaaggagacggaaaaagagcatctcggcatgggagcgtggcgcttttatatcgaacttcctgatcacacatttgaggacgcgacattgatgtacagaagcggagacacacaaatcggggtggtgccattggcacaacacgctggctatgtcttcgtcctccagccttgcacgagcgattactgggatgaggaagatacccggtttgatagagtaaaagagattctttctggttttcgggggctggattttgtcacaaagcacatgtcaaaacagcatcctgtcatctttaacaaactggagcaggtcgccgtgcaggagccatggcataaaggccgcgttgtcatcggaggagacgccgcccacgccggcgcgccgaccctggcgcaaggagcggcaatggcgatcgaggatgccatcgtcctcgccgaagaactccaaaaccacgccgatcacgaaacagcattacaggcgtactacaaaagaagagccccacgagcgctcaaagtccagaacctatcatcggaaatcgtccgccgcgggctgaaaggagagccgggagcggaagaactgattggggagtgctatgcggtgttgagggaagggtattaaataggaaaagtccagaaagtgatttctggactttttagtcttgctctgttttattccttatccgctcaatcacctcatgcagcccctcaggcttataaaactccaccggtgaactgcctttctcaaacgaaatcgtctcggcttcaatcagcgcgacatagcgcccgtttacttttgcgagatgaatagaatcgccaaaatccgctagcaatcccttaatctctgtttctccgactttcattttcagctgggcctctggcgtgtgctcgatgatttgggcggaggcttcgatgacttgatgggtgtcgaggcgctcttggatttcccgtttttcgcttgcttcccaaatctcaatgtcgtgctcgaactgcttgagttcttcgctgttgtcttcaaatgtctcgtagacgtgctcctgtaccatgttcatgacctggtttttcatgatttccggcatcgattctccgtactcgacgaatttcagaaagtcctcaaaatagcgggcgtgcgaggcctggtggattttcagttcaccttcctcgaccattccttcctctggcatgtacgggtattggatgcttttcatgttttttgtcgtgatcgccatttcgacttttttaatgagagaagacgcgtcagagatgcgggcgaccttcggctcaaaatcacatttcataatgaagacaaatgactcgtcaaagtattttctcggcacggccgaagcgacgagaaacacgccgccgcgaaccgcgcttgtgtcaaggtacgtgcggacgaactgctcgctcagctcattgaagtcttcttttgtttccgccagacgcgcgcggttgaacatgttgtagtttgggttggaatcgagctcgtggccgggctcgacgataaaatggccgattttcgtcggcacctgctcggactgcggatggcggtctgctttccgtttaacgatttttttcagttccccgtcgagaaagtccttcagctcgctttcttcaaattcgcccgtatcaagggtctggaagtgcttgaactgcttgttcgcctgctcatctttgccttccacctgtatgacataaaaggataaaaaccgaatttcaaaatccatatataaactcaccttattcgcgtattgtacagcttctcaagtatagaaaaaacagcgatcatgcgtcaattgggagaacggaataatcatgaccatgaaagggaaatgtagtcaaatagaaggcatctcatacggaaaggaatggttcgatgaaggaaacaagcccgattcctcagccgaagacgtttgggccgctcggcaatttgcctttaatcgataaagacaagccgacgctttcgctgatcaaactggcggaagaacagggcccgatttttcaaatccatacacccgcgggcacgaccattgtagtgtccggccacgaattggtgaaagaggtttgtgatgaagaacggtttgataaaagcattgaaggcgccttggaaaaggtccgcgcgttttccggtgacggattgtttacgagctggacgcatgagcctaactggagaaaagcgcacaacattctgatgccgactttcagccagcgggccatgaaggactatcatgagaaaatggtcgatatcgctgttcagctcattcaaaaatgggcaaggctcaatccgaatgaagcagtcgatgtcccgggagatatgacccggctgacgctcgacaccattgggctatgcgggtttaactaccgctttaacagttactacagagaaacgccccacccgtttatcaacagcatggtgcgggcgcttgatgaagcgatgcatcaaatgcagcggcttgatgttcaagataagcttatggtcagaacaaagcggcaattccgccatgatattcaaacgatgttttcgttagtcgacagcattattgcagagcgcagggcgaatggagaccaggatgaaaaggatttgctcgcccgcatgctgaatgtggaagatccggaaacgggtgaaaagctcgacgacgaaaatatccgctttcaaatcattacgtttttgattgccggccatgaaacaacgagcggcctgctttcctttgcgacttactttttattgaagcatcctgacaaactgaaaaaggcgtatgaagaggtcgatcgggtgctgacggatgcagcgccgacctataaacaagtgctggagcttacatacatacggatgattttaaatgaatcactgcgcttatggccgacagctccggctttcagcctttatccaaaagaagacacagtcattggcggaaaatttccgatcacgacgaatgacagaatttctgtgctgattccgcagcttcatcgtgatcgagacgcttggggaaaggacgcagaagaatttcggccggaacggtttgagcatcaggaccaagtgcctcatcatgcgtacaaaccattcgggaatggacaacgggcctgtatcggcatgcagtttgcccttcatgaagccacacttgtgctgggcatgattttaaaatatttcacgctgattgatcatgagaattatgagcttgatatcaaacaaaccttaacacttaagccgggcgattttcacatcagggttcaaagccgtcatcaggaagccattcatgcggacgttcaggcagttgaaaaagccgcgtctgatgagcaaaaggagaaaacggaagcaaagggcgcatcggtcatcggtcttaacaaccgcccgcttctcgtgctgtacggctcagataccggcaccgcagaaggcgtcgcccgggagcttgcggatactgccagtcttcacggcgtaaggacagagacggcacctctgaacgaccggattggaaagctgccgaaagagggagcggttgtcattgtgacctcgtcttataatggaaaaccgccaagcaatgccggacagttcgtgcagtggcttcaagaaatcaaaccgggtgagcttgagggcgtccattacgcggtatttggctgcggcgaccacaactgggcgagcacgtatcaatacgtgccgagattcattgatgagcagcttgcggagaaaggcgcgactcggttttctgcgcgcggggaaggtgatgtcagcggtgattttgaagggcagcttgacgagtggaaaaaaagcatgtgggcggacgccattaaggcattcggactggagttgaatgaaaacgccgataaggaacgaagcacgctaagccttcagtttgtcagagggctgggcgagtctccgctcgctagatcgtacgaagcctctcacgcatccattgccgaaaatcgtgaactccagtccgcagacagcgatcgaagcactcgccatatcgaaattgcattgccgccggatgttgaatatcaagagggcgaccatcttggcgtattgccaaaaaacagccaaaccaatgtcagccggattctccacagattcggtctgaagggaaccgatcaagtgacattgtctgcaagcggccacagtgcggggcatctgccattgggccgtcctgtcagcctgcatgatcttctcagctacagcgtcgaggtgcaggaagcagccacaagagcgcaaatacgtgaactggcggcatttacagtgtgtccgccgcataggcgcgaattagaagaactgtcagcagagggtgtttatcaggagcaaatattgaaaaaacgaatttccatgctggatctgcttgaaaagtacgaagcgtgcgacatgccgtttgaacgatttttagagcttttacgtccgttaaaaccgagatattattcaatttcaagctctccaagagtgaatccgcggctagcatcgatcacagtcggcgtcgtgcgcggccctgcgtggagcggccgtggcgaatacaggggcgtggcttcaaatgatttagctgagcgccaagccggtgatgatctcgtgatgtttgtacgcacaccagaatctcggtttcagcttccagaagaccctgaaacgccaatcattatggtcggacctggcacgggagtcgcgccatttcgcggtttccttcaagcccgcgatgttttaaagcgggaggggaaaacgctcggtgaggctcatctctattttggatgcagaaacgatcgtgattttatataccgcgatgagcttgagcagtttgaaaaagacggaatcgtcactgtccacacagccttttcccgcaaagaaggcatgccgaaaacgtatgtccagcatgtcatggctgaccatgcagaaacgttaatatcgatccttgaccgcggaggcaggctttatgtatgcggtgacggcagcaaaatggccccggatgtggaggcggcactgcaaaaggcgtatcagtctgtccatggcaccggggagcaagaagcgcaaaactggctgagacatctgcaggataccggtatgtacgctaaggatgtctgggcagggatatagataaagaagactggagacatccagtctttcagcgtgtcggcaaaccctcgcattcgttgtcaggactgcgcttcggtgctcaatgcgaagtggatcaacggctaaattctcaggcgtcctgcctaaacgccgtcgtcatcacatcctgtgaatatccgctcctatgctcgtccttcctagacttcaagggttttcaatcacgctgaaaagatgacaaaatcctaaaatggttttcattttaggattttgtcaacaatctggaagactggagacatccagtcttttttgtcctttcgaaaaaatggtgatcgcgctaaacattgatgcatacaataacttcagtccgccggaagggcgggctgtctgcaaaacctatttttcgtttttgctagtttatgttattcttatactcggtatctatttcttttttcaaaggcacacatgacaaaagaaatcctttttttatttcggagaaaaaaatgtgaaacgaaatgaaggtttctttcgtccagtgattggtttccaaatggttgtaataaaaatgatatggtgcgtaacataaatattccggcttgccgcggtgtatttcttgttgtgtgatgccttgattttgtttggaaagaaggaattggaaggcaggatataaagagcaggtaaatatgaatgaagaacttaaagtgtttaagaaagtagaggttgccatgaagaaacttttttcttacaaacttagcttttttgtgctggctgttatactgttttgggcaaaaacgtatttatcctacaagactgagtttaatcttggggtaaaaggcacaactcaggagatcctcctgatatttaacccattctcaagcgccgtcttctttttaggactggctttgctggcgaaagggcgtaaatcagccattattatgctgattatcgatttcttgatgacatttgtgttatatgcaaatattttattctatcgtttctttgacgatttcttgacgttcccgaacattaaacagtctggaaacgttggaaacatgggagacgggattttcagtatcatggccggtcatgatattttctatttcttagatattatcattttgattgcggtattgatctggagacctgaattaaaagaatacaaaatgaaaaaacgctttgcatctttagtgatcctttctgggatcgcactgtttttcatcaacctgcactatgcggaaaaagaccgtccgcagctgctgacaagaacgtttgaccgcaattatattgtgaaatatttaggtttatacaactacaccatttatgacggtgtacagacggctcaaacagaaacgcaacgggcctatgcaagcagcgatgatttaacaagcgtcgagaattacacgacgtctcattatgcgaaaccgaacgccgagtacttcggctctgccaaaggcaaaaatatcattaaaattcacctcgaaagcttccagtcattcctgattgactacaagctaaacggtgaagaggtgacgcctttcttaaataagcttgcgcacggcggggaagatgtgacgtattttgataacttcttccatcagacaggccagggaaaaacatctgatgccgagctgacaatggataactcgatcttcggtcttcctgaaggctccgcgtttgtgacgaaaggcgaaaacacctaccagtcgcttcctgcgattttagaccagaaggaaggctatacaagcgccgtcctgcatggtgattacaaatcgttctggaaccgtgaccagatttacaaacatatcggatacgacaagttctttgacgcaagcacgtacgatatgtcggatgaaaatgtgattaacatgggacttaaggataagccgttctttactgaatcgattccaaagcttgaatctcttaaacagccgttttacgcgcatttgattacattgacaaaccattatccgtttaacttagatgaaaaagacgcgtctcttaaaaaagcgacaactggcgataacacagttgacagctacttccagacagcgcgttaccttgacgaagcgcttgagcaattcttcaaggagctgaaggaagccggcctgtatgacaactcagtcatcatgatttacggtgaccataacggtatttctgaaaaccataaccgagcgatgaaagagattcttggaaaagagatcacagattatcaaaacgcacagaaccagcgtgtgccgctgatgatccgcgttcctggcaaaaaaggcggagtgaaccatacgtatggcggcgaaattgacgtcatgccgacacttctgcacttagaaggaattgattctcagaaatacatcaactttggtactgacttattctctaaagaccacgacgatacagtggcattcagaaacggagacttcgtaacgccgaagtacacatcagtcgacaatatcatttacgatacgaagacaggtgaaaaactgaaagcgaatgaagaaacgaagaatctgaaaacaagagtgaaccagcagctgagcctttcagacagtgtcctgtacaaagacttgctgaggttccataaactaaatgatttcaaagctgttgatccgtcagactatcattacggcaaggaaaaagaaatcaaataagatgaaaaagagccttgagcgggcgcattgccttcgctcaaggctctttttttggttatacaaccaacttgaaaaaatagattccatttggtcaccaaggctggctttctctcatatcattacagtagattttgaaaccggattgaaatcggacaaattatcggggaaatgccttgatagattgtgaagatgtaccaggtttcgaactcaatattcatagagatgaggggtagagatgaaagcggtcattctctgcggcggaaaaggaacgagaatgagtgaagtcacgaatgacattcctaaaccgctcgccatgataggcggcaaaccgattctatggcatattatgaaaatttatcagtactacggagtaaacgagtttattctgcttttgggctataaaggagaaaaaatcaaggaatactttctcgactatgaatggaagcacaacagcctgacactcgacagctctacgggagaggtacagatgctgggacagcctgaaacgtggaaaattacgtttttggagactggggaagatacgctgacagccggaagaatcttgcaggcgaaagactatatcggtgatgaaacatttctgcttacctatggggacgggctggccaatatcaatcttttccatctcatcagctatcatcagacaaaaggtgctgccgcgactgtcaccggcattgacaaagtctcgcagtttggcaccttgacggttgaggacggcatggcgaaaacattttctgagaagacatcaagtgacggaatcatcaacggcggattcttcgttctcagtccaaaggttttcgagtatttgccgaaggacgggaacgcgatgttcgaagatgaaccgctgaagaaccttgccaaagacggggagcttgctgtgtaccgccattacggattttggacggccatcgatacgtataaaaatctcttagaagtcaacaaaatgtggaatcaaggacaacaagtatggaaggtatggtgaatcgatttgagtttctggaaaaataaaaacgtatttgtcacgggatccacaggtcttttaggaagctatttggtgaaagagctgatcgatcagggcgcaaacgttacggggcttgtcagggatcatgtgcctcaatccaatctttatcagggagaacatatcaagaaaatgaatatcgtgcggggctctcttgaggacttggctgtgattgaacgcgcgcttggcgagtatgagatcgacactgtctttcatctcgctgcacaagcgattgtcggcgtagcaaaccgcaacccgatttctacctttgaagcgaatatcctcggcacctggaatattctcgaagcctgccgcaagcatccgttaattaagcgggtcattgtcgcttcaagtgataaagcttacggcgatcaagaaaaccttccatacgatgaaaacatgccgctgcaaggcaagcacccgtacgacgtctcaaaaagctgcgcagatctgatcagccacacctattttcacacgtacgggcttccggtctgcattacgcgctgcggaaacttatacggcggcggagatttgaacttcaaccgcatcattcctcagacgattcagcttgtgctgaacggggaagcgccggaaatccgaagcgacggcacatttgtacgggactacttctatattgaagacgccgttcaggcttatctgcttcttgcagaaaaaatggaagaaaacaatcttgccggagaggcctttaacttcagcaatgagatccagctgaccgtacttgaactggtagagaaaatattaaagaaaatgaacagtaatctgaaacctaaggtgctgaatcagggaagcaatgaaatcaaacatcaatatttatccgcggaaaaagcaagaaagctgctgaattggacaccggcctacactattgatgagggacttgaaaaaacgattgagtggtatacggaattcttcaaaaagtaatgtgaaacgaggtgaacaagactgtgaccagcgcgtattgcaccgttttatcaaaaggaagattatatcaggcagtcgctttgtttaagtcgttagagcaagttgatcaagacagtcccatttttatactttgcatggatgaagatacgcaccgcgtgttacagaagctgaagatgaagcagctgaaccttgtgccggtggccgctcttgaaaatgaattgctgctgaagctgaaggaaactagagatcaaagtgagtattgctggacgatgaagccgatctttctgcaagctgtgctgaacagcaatcccgagctggagcgcgtgacgtatattgacggggacctctttttctatgcagatccatcgccgatttttgaaaaccagccggactgctcggtgctgctttcacggggggatattgtaatcccttcttttgagaaagagcagattgacatgctgcagcgtcttttaggcagatataattccgggtttatcagcttcaagcatgatgatgcaggcacggattgcttggagtggtggaaggaacgctgtcttgaggaatgcaaaaatgcaccgggtgaagggaaattcggtgatcagggctatttggattatatgtctgagctgtttccgaatgtgtgtgacattacaacacccggcgtgaacatcggccattggaattatggacagcatacgttttcctggaaagatggccggatcgtgctggaggatggcagtccgctgatcttttatcatttcagcggataccgaatcgtcagcatcaatgaaatcaaacagattcatgaaacaacccgcacagatctgccgtttgtgcatgaactgtatcaagagacactgccgcatatcattcagcacatgaaaacgttagaccctgaatttaacggttttgcttcaaaagatgacaacaaataaatgagtaaatacaggaagtgaaaatgaagtgaaagcaagcgttattattcctgcatataattcaaaggagcgtctttacaacagccttctgtcattaaaccagcaggagtgcgatgaagaattcgaagtcattgtagcggacaatggctctgaggacgggacgctctcgatgcttgagtcatttcaagctgattttccgctgatctttacacggattaaagaaaacaggggcattgcgtacggacgaaatcaggcgcttcgcaatgccagaggagacatcctgattttccatgacagcgatatgcttgcggcaaaggaccttgtggcaaaacatattaaagcccatgagaacgaagagaatctcgtcgtgtgcgggttgttttggaaacggatctacagtttttactatgaacggtttgaagaagaacataaggaacagctcgcaaagctcacaggtgaaatgccgaagaaagacaaacaaaagctgctggaggaagcggacatcaaaaacggaagctttcttgataaaagctttgacctcgataccgactttatagacgtgctcaagaagattttagatgagtacggcgatgacttgaaaggctatcatatgccatggcgcttttttatcacgaataattcctctgtgaaacgcaagcatgtggttgacctcggtttatttgacgaaggcattgtgcggtacgggtttgaggattatgacctcgggatcaggcttcatcaggccggattgaccttcaggcttcgccgtgatattgtcagtgttcatcaggaacatccaagcaattgtaagtctgtagacgatattcgggcaaacattgcctatatgtgcgataaatacaataacatccgctccttagacgttcatctcgcttttaatgggccgttcccgcctgacatgacgaacagaatcatggctgatattcaaaagctgctggaatcacagaaatatgatatgctgctgaatctgtttcttgagcttctgcatgttgttaaagagcgcaacattgatccggattggcgaaagaaatccccaagggtgacggcgaaaagctttgatttacaaactgtccgcaagcttctgcctaaggcgaagaaaaagctaggcgtgaacgattttgccaacgcactgtatgcgcttgtcaacgatttgctgcacgtggatcttagatcattggatgtggtataagtgagtacatttcatttttcaacgatagtgtcaaggacacatatctttaagctcatgcctatgattcattctctccatgagcattgcgatgattttcatttatatgtgctgtgtgtcgaccagaaagcgtatgaattgcttcagcacgtgccatgggagcatgtaacctttgtgcagctgcatgaaatggaagacccggagctgctgaaagcgaaaagcaacagaacgtttcatgaatattgctggacgttaaagcccgcctttttgtttcatgtgatgagcaagtgggatgacgctgaatactttgcccatatggatacggatctatttttcttttctgatccggcacgtatttttgcagaaaacccaacggcgtctctgtatttgactgatcatcgtaattcgccgcgcttcatgtcctactacgaccgaaccggacgctttaatacaggctttgtcggcgccggtaatacaaaggaagcatatgaagcggtgtggcagtggagacaggactgtattgaattttgcacggtcgaaatggatacggaacgaaagacatatggtgatcaaagatatgtggagaaatggccggagcagtttaaaggtgttcatgttgtcaaatccataggagccaatacagcgctttggaatatcgaaaactataaggtcgggcaaaaggacggccgcgtgtatatagatgaaacgccgctgattttctatcatttctctgggtttacgctggtgacagaaaaagagtttaatctttgctggtactaccggattgaagacgaagcgacaattaagatgatttatatgccctatatattaaatctgaaaagatggattgatgaaatacagtcggcgtttccggactttgcggatggctttatcccgaagcacgcagtgcctgacactcattttatccagctggattaaaaaaccccctgccgcctggcaggggttttttcagctatgccattctctcagcttctggtcacttggcaataggaaggcaaggatgccgaggacagggagaaaggcaatggcgatcatcgtcggggtcagtcccgcggcatcaatcagagcgcccagcgccacagcgccgattgcgcccatcccgaaggcaagcccgacggttaaaccggacattgtgccgatttttccaggaactagctcctgtgcgtagacgaccgttacagaaaagctcgacatcagaaccaagccaatcaatgcgagcacgccgtaggcgagaaccgggccggcaaatggcagcacaatcgccagcggcgccgagcataacagcgaaccgaggataacgaagcgttttccaaaacggtctgcaagcgggccgccgagaaacgtgccgatcgcgccgaacagcaagaagacaaaaatatagctttgtgcctgctgaatgcttacgtgataggtatccatcgcgtaaaacgtgtaaaagttaccgatcgcactcgtataccaagaacgagcaaaaatgagaaatataataataataagagcagatacaacagatttggtgatggccgtgttttcagccgttttcttttgcttgcctgatttctgggcaaggctgccgagacgtgaggcgtaccatttcgcaatatacatgagaaacataacagcaagcgcggcgacaagcgtgaaccaaacagcgccgaattgcccgagcggcacaaggatcagcgcggtgatcagcggtgccatcgcctggcctgagtttccgcccacctgataaatcgattgggcgagcccgcgttttgtgccggcggccatatacgccacacgggagccctccggatggaaaatggccgagcctaatccaatgaaaaacacacagcataagatcgttatgaatgacggggcaaatgcaaggcccaaaatgccaagcatgctggcggtcaaaccgactggcagcgcatacggccgcggccgtttatcggtataccagccgacaacaggctgcatgacggatgacaccatgtttaatgtgaaagcaatgatgccgagctgtgtaaacgtcaggctcatggagcgttccaaaatagggaacatggccggaatcacagcctgaagcgaatcgttgagcatatggcaaattccgataataatcaaaatcggatacaccgtggtgcctggtttttgaactgttttttcttttaacggggcggcgatagccattgagtctcctccttacatatataaccaaagcataccaccatattattcataaggtgaagaatttatcaagaggaaaaaagattcttatgaaagaaataccgtcagcctgattagcagctgacggtattttcgatattcaaaatgtgatatagctcttcaagcttacgaatctcataggttggtatgatctctggcacattcggcttcatgtcagggttcatccagcaagtatcaagcccggcgagctgtccgcctttgatatcagcagttagtgaatccccgatgattaatgtgtgctctgctgaaaattgaggaatccgttcaaacacgtaattgaaatattccttcatcggcttttggaagccggtgtcttcagaaacgaaaatgtccttgaagaatggaaataatcctgaatcacggagacgcttatattgtgtgtgagacacgccgtttgtcacgatgtacaaatcaaactgttgctgcagatttgagatgagatcaaatgcaccgtcaataagctgatgtccttcttcaagaaagcggcggtatttttgctcaagcaaagcgccgtccgcttcgtaaccgtactccttgagcaaagcggaaaaacgtgtgtttacgacttcatcccgtgtcatcttaccttcttcaaaggctctccagagaccttgattgatggttttatactgcgccttcatgtcatttgttaaaggaatgttctgatcttcaaacagcaaacgcagggctaaagcttctgccgcttgaaaatcaaggatggtatcatctacatcaaataataaagtgcggtatcgcttcatctgtgtgtctccctttctcatatgtattcaaagtatagcacataaaaaaaggaaaaagccggcgggtgaggcaccgccggctgaaaagagattatttgtttaataagctgtgttttctcgaatataggaagtaaaccagcgttccgacagcgatccagatgacaaatgaaagccatgtgacgccgggaaggctgtacatgaaccaaaggcagatgcctgcgctgataatcggcacaaccggaacgaatggcactctgaaggacgctttgatttcaggatgtttctttcttaacacaatgacagcaatggaaatgaccgtaaacgcggcaagtgttcccatgttcaccagatgggccagcgttccgaggttaataaagccggcgattcccgctgcaacgatccctgtcagccatgtgttgcggaacggggttttaaatgacggatgaacctttgcgaacaatccaggcagaaggccgtctctgctcatggcaaatgtcaagcggacctgtgcgtacagcaaagcgagcatcaccgtcgtaatcccgataatcgcaccgacagaaataattccggcaacagcgtcctgtccgacgaatttcagcgcaaaggatacaggatctccgacattcaatttggcataaggcatcatgcctgtcagcacaagcgataccgcgatgtacagaaccgtacagacggctagagctgaaataatgccgacgggcatgtttttttgcggatttttcacttcctctgatgcgttagaaaccgcgtcaaacccaaggtacgcgaagaatacagtggcagcgctaagtatgacgcctttcatcccgaatggcataaaaggagaccagttatccggtttcacatagccgatgccgacaataatgaacaataatatgatcgcgattttcatcagtacgatgacgttgttaaagcgtgtgctttccttgacgcctctgctgacaatcgcagtgatgaggagaatgatcaccgcagccggaaggttaaatacggcgcccgccgtgcttcccggcgctcctgtcagtgcagccggaatatgaagattgaagccggcaagcagtgattgaaagtatgaagaccagccggtggcaaccgccgacagtgcaatgacatattcaagcatgagatcccatccgatcaaaaaggcgagcagctctccaagtgtcacgtatgagtatgagtacacgcttcccgaaatcggaatggaagacgaaaactcagcataacagaaagcagccagcgcacaggcgagccccgctaaaataaacgatatgatgagggcgggacctgcaccggtcgctgccactgttcctgtaatgacaaaaatccctgtaccgatgacacaaccgataccgagcaaggttaaatcaaatgcgcttaacgtacgggcaaggctttttgacttgctctgcgcactcaatgtttcaagcggtttttttctaaataatgaactcatcaaaagttcctcctagaaatattcaaaatattctaatcattatatgcagttcttgttgtattatattgtcgaaatttgacgtagtcaataaaatatttttctgctttaaatgatagaagcgaaacagcgttgtcgtatcataggatagtaatttttactaatcgtatattcaattttatgcaagatgaaccgatagaaaaaatagattcgcccatattttgatttgcggttataaaggagatgctgaccatgtttcaatatgaagagttgaataaacagtttatcggcgggaaatggcaggagggcagcagcccaaatgtattggaaaacaaaaatccttatactcaaaaaacattcacaacattccgtaaagcgactgctgacgatgtagatgaagcgtatcgggcagcggcgctggcaaagaaaaaatgggatgcggtcaacccgttcgagaaaagaaccattttagaaaaagccgtcacgtatattgaagaaaatgaagaagccattatttatttgattatggaggagctaggcggtacaaggctcaaagcagcttttgaaatcggtcttgtcaaaaacatcataaaagaagcggcaacgttcccaatccgcatggaggggaaaattcttccgtcaacaatagatggcaaggaaaacagattatatcgcgtgccggcaggcgttgtcggtgtcatcagtccgtttaacttcccattctttttatctatgaaatcagtggcgcctgcactcggagccggcaatggcgttgtgctaaagccgcatgaggaaacgccgatttgcggcggaacgctgattgcgaaaatttttgagaacgcgggaattccagcggggctgctgaatgttgttgtcacagacattgctgaaatcggcgacagcttcgttgagcatccagtgccgcggatcatctcatttaccggttctacgaaagtcggcagctacatcggacagcttgcgatgaagcattttaaaaagccgcttcttgagcttggcgggaacagcgccttcatcgtacttgaggatgcagatatagaatatgcggtcaatgcggcggtgttcagccgatttacacatcaagggcagatttgcatgtcagccaaccgcgtgcttgttcattcttctatttatgacaagttccttgagctgtaccaggcaaaagtggaatcgctgaaagtcggcgacccaatggaccctgatacgattatcgggccattaatcaacagcagacagacggacgggctgatgaagactgtagagcaagcaattgaagaaggcgctgtaccagtgaagcttggcggatttaacgggacgatcgtggaaccgacgatcttaaaagacgtcaaaccgttcatgagcattgccaaggaagagctgttcggaccagtcgtctcctttatgaagtttgattcagaagacgaagcggtggatatcgcaaacgaaaccccgtttggcttgagcggtgccgtacatacgtcaaatcttgagcgcggcgtggcttttgcgaaacgcattgaaacaggcatgattcacgtcaatgacacgaccatcaatgatgaaccgaatgtagccttcggcggtgaaaagcaatcaggcctcggccgtttaaacggtgagtggagcctcgaagaatttacaacgctgaaatggatctcggtccagcacgaaaaacgcagcttcccttattaatgaaaaggagtgaatggaattgaccataaatacggaaaaagaaaccgcagatattctggacgcatttatcaaagtagccccttatttaaacagcctggttcaggatgatattacaatcggcatttatgatacggaaaaactgctcgtgaatataccggccaaaaccttttcgctgaacgtaaaagccggcgatccgctgcaggaaggggatatcatcacagatgccatccgcagcaatcagaagaagacgagcatggttccgaaagaattgttcggcttcccattgatcgcgcgtgccatcccgctgcacgacgagaatggaagagtcattggaggcgtcggcctcggaacgagccttgaggagtcgtcaaagctgcatgatgtcgcggaaagcttatcagctgttgttgaacaaacagccgcggctatttccgacatttctgaatcaattaacgggttttcaactcaaatgtcgggcatttcctctcaggcgaaaaaagtaagcgaaagcgccggtgaaatcgccgatatttcagtaactgttaaaggcatctcggaccaaagcaatctgctcggcttgaacgccgcgatcgaagcggcaagagcaggggagtccggaaaaggattctctgtcgtcgcagatgagatcagaaagctagcgacgcattcaaaagaaaatgtcggccaaattgaccagattacgaaaaaaatccacagcctgctgaaagggctggaggaatccattgagtcgattaaccagcatacagacggacaagccgctgctgttgaacaaatttccgccacgatgcaggagatttcaggaagcgcgcagcatcttgcgaaaatggccgaaaaagcgcttgaggaagagtaagagaccggggacaaacatccccggtctttttcttatcctgcatttccatgaaattcgtctgacgttttactagttttattccagcggctgatttaaaatgtacacatgaacttacgtgaggattgataggaaccatgagcatattaaaagcggaaaatctttataaaacatacggagataaaacattatttgaccatatctcctttcatattgaagagaatgagagaatcggattaatcgggccgaacggaacaggaaaatcaacgctgttgaaagtgattgccggcttggaatctatcgaagaaggagaaatcacgaaatccggaagcgtgcaggtcgaatttcttcatcaagacccggagctgcctgcggggcaaacagtgctggagcatatctattccggtgaatcggctgtgatgaaaaccttgcgtgaatatgaaaaagcgctgtatgaactggggaaagatcccgaaaatgaacagcgccagaaacacctgctggcagcacaagcgaaaatggacgcgaacaatgcatgggatgcaaacaccttggcaaaaaccgtattgtctaagctgggcgtcaacgacgtaacaaaaccggtcaatgagctctcaggcggccagaaaaaacgggtggccattgccaaaaacttaattcagcccgctgatttgctcattttggacgagccgacaaaccatttggataatgaaacgattgagtggcttgaagggtatttaagccaatatcccggcgccgtcatgctggtgacgcacgatagatatttcttaaaccgtgtcaccaaccgcatttatgagcttgaaagaggcagcctctacacttacaaaggcaactatgaagtgtttttagaaaaacgcgcggaacgggaagcgcaggctgagcaaaaggaaacgaagcggcaaaacctgctgcgccgcgaactggcttggctcagacgaggagcgaaagcccgctccacaaaacaaaaagcgagaattgaccgggtagagacgcttaaagagcagacaggccctcagtcatcaggttcactcgattttgccattggctcgcaccgtctcggaaaacaggttattgaagcggagaacgtcatgatcgcttatgacggccgcatgctcgtcgaccgttttaatgaacttgtcataccaggtgaacggatcgggatcatcgggccgaacggcatcgggaaaacaacgctgttaaatgcccttgccggccgtcatacgccggacggaggcgatattacgatcggacagacggtcagaatcggctactatactcaggatcatagtgaaatgaacggtgagttaaaagtcattgactatataaaagaaacggcggaggtcgtaaaaacggcagatggcgatatgattacagctgaacaaatgctcgagcgtttcctcttcccgcgttcgatgcagcagacgtatatccgcaagctgtccggcggggaaaaacgccgtttatacttgcttcaggttctcatgcaggagccgaatgtcctgtttctcgatgagccgacgaacgatttggatactgaaacattaagcgttcttgaggattatattgaccagttcccaggcgtcgtcatcaccgtatcccatgaccgctatttccttgaccgcgtcgtcgaccgtttgattgtatttgaaggaaatggtgtcatttcccgctttcaaggctcctatagcgactatatggaggagtcaaaagcgaaaaaagcggccccaaaaccggcagctgaggaaaaaacggctgaagccgagccgaagaaaaaacggaaaaagctttcttacaaagaccagttggaatgggacggcatcgaagataaaattgcccagctggaagaaaagcatgaacagcttgaagctgacatcgccgcagcaggcagtgattttggcaaaatccaagagctgatggccgagcaggcgaaaacggcggaagagcttgaggctgcgatggaccgctggacagaattgtccctcatgatcgaagaactggaaagctaaaaagcgtggccgcagcaggccgcgctttttttcacataatggacaaaaacgaaccggcctgcttatgttaggataaagttgtgtgtcagcggcacatggaaaactaacggagatgatgaagtatgacatgggcgatcgtgatgttaattctcatgagtctggtgaaaatcgtattaacctgtcttcctacaggcgtcatagaatggctgctcggcaaatttgaagtgcacgccaagctgagtgacgaaaatgcgagtctctctctagatggaaaacgcctcgagggtgcagagaagcagaaagtgattgatcaatttaacgaagctatcttcctggaaaaatattatatctatccaggtgatgaagagcgttatttacatccggaaaacggcggcacgcctctggtgatagatacaaaaaaaggaaaaaaagacgtgaagctgttcgtgtaccgctacgacgaccatatcgacgtcgtgaaacagtacaagaagaaagtgatcgcgtatcgagtgctttctgaaagccttcaaaaagagtctctgtcagtggcgggaagtttagcttaaacaggaaagtgaaagacgggtgctgtatgctgctcgtcttttttattgttttttaaaacttaacgtttacgttaaggttcaaaaggtgtataatggtaacagaaacggcgaagggggatttaccttggaatggatgaagattgatcaagtggccaaaagaagcgggctgacaaagcggaccatccggttttatgaagaaatcggcttgattccggcgccgaaacggacagacggcggtgtaaggctttattcagaggatgatatggaggagcttgagaaagtcatcagcacaaaagaggtgctcggtttttcccttcaggagcttcagcatttcatggaaaccagccgccagctagagttaaacaaagaggggtatttgttgtcactggatcctaaggaacggaaagaaaaactggaggaaattcaggaaaccctgaatcaccagctggatttgattgatgagaaaatccgcacattccaaagctttaaagaacgcctgcagggcatgaaaaataaagcggaacgcgccattcaatcaatcgaatgaaaagtttgttaaacgctatttttgtagcgtttcttttaatggaataaagatggaggttaggtcaaatggataagacaacacaagtgaatcagaaaacgggtttgctcagccagccaaaagcggtatgggctgtcgcgtttgcctgtgtgatttcctttatgggaatcgggctggtcgatccaattcttccggccattgccgcacaactacatgcttcacctagtgaagtatcactcttgtttacaagttatttgcttgtaaccggatttatgatgtttttctcaggagccatttccagccgcatcggcgcgaaatggacattaattctcggacttatttttattattgtgtttgcggggcttggcggcagctcaagctcaatcgctcagttagtcggctatcgcggcggctggggattagggaatgctttgtttatttcaacagcgcttgcggtcatcgtcggcgtgtcagtcggcggcagcgcccaagcgattattttgtatgaggccgcgctcggtctcgggatttctgtcgggccgcttgcaggcggagagctcggaagcatttcatggcgcgcaccgttttttggagtatctgtcctgatgtttattgcgttaatcgcgatttctttcatgcttccgaagctgccgaaaccggcgaaacgcgtcggtgtgtttgatgcgatgaaggcactcaaatataaaggcctgctgacaatggcggtatcggcattcctatacaactttggattttttattttgctagcttattctccgttcgtactggatttagatgaacacggtcttggatatgtcttcttcggctggggccttctgctggcgattacgtcagtctttacggcgccgctcgtgcacaaagcgctgggcacagtgcgttcgctcgtcgttctctttatcgcctttgcggccattctcgttattatggggatctggacagaccatcagactttgattattacatgtatcgttgtcgctggtgctgtcctcggtatggtgaatacgatcatgacaaccgctgtgatgggttctgcgccggttgaacgttcaatcgcgtcttcagcctacagctcagtccgcttcatcggcggcgcgctcgccccgtggattgcaggaatgctgtcagaacactttactgcaagcacaccatatacagtaggcggaatcgtcgtttttgtcggcatgcttgtccttctcatgggacgtaaacatcttgctggaattaaggcggggcattaataacgaaagacactgcacagatgcagtgtctttttttaatcgtggaatctccccattactaccgtattgtagtgatttccgtcagaaagcaatttctccttttttaagattccttctgcttcaaatacgtatgtttttatagtgaaatggctctttaatttgtttccaggatattcagtgagatttttttaattccgttggcatccgcttcggtcaggcattgatgcggctgggatttatcttgcagaagctgagaatgtgtccgttcatttacgattgccatttcaagtgatggttcatgctgtagagggaacgtttgccatggataaggcaaagcctgacgaatatgatcataaatgtttagaaacgctctatcaatacatacacagcgtcatgaaaaacagcttttctcggtcgagtggtttaccgcttgggcagatgaggaggattttgagctgtctgccaaaaaagagctgacccttgatgaattcacatctccattgcagctcattttaaaagacagagagcttttgagaatcgttaagaataaacggcagtaaaaaacccgcccttcagcaggcgggtttttttataaattaaagcactttcgtcgtccaagactcgcagttccatgtttctgtcgcgatatccatataaaagtctggctcgtgggaaatgagcagaatggagcctttatattctttcagagcgcgcttgagctcttccttggcatcgacatccaagtggtttgtcggctcatcgagcaccagcaggtttgtttctgagttgattagcttgcacaatctgactttcgctttttcgcctccgcttaatacggagacgcggctttcgatatgctttgtcgtcagcccgcattttgccagagcggcacggatttcatactgcgtataagaagggaattcgctccatacttcttcgatgcacgtattgttgtttgtttccttgacctcttgctcgaaatagccggtatagatgtgctcaccgcgttcaacagagccttcgagcggctggatttcaccaagcaaacttttcagcaatgtcgtttttccgatcccattcgcgccgtaaagggcaattttttggccgcgctccatgcggaggttgagcggacgggacagcggggaatcgtaaccgatcacgagatccttcgtttcaaaaatcagcttgcctgacgttctcgccggcttaaagtggaattccggctttggcttttctgccgcaagctcgatcatatccatcttatcgagtttcttttggcgggacatcgccatgtttctcgtgctgacacgcgctttgttgcgggcgacgaaatccttcagctccgcgacttcctgctgctgctttttgtaggccgcttcaagctgctgttttttcacctcgtagacttccataaactgatggtagtcgccgacataacgtgtcagctcttgattttcaacgtgataaatcaggttgatgacactattcaagaacggaatatcgtgggaaatcaggatgaacgcgttctcgtattcctgcaggtagcgtttcagccattcaatatgctgttcatcaagatagttggtcggctcatcgagaagcagaatttccggcttttcaaggagaagcttagcgagaaggacctttgtgcgctgtccgccgctcaaatcggtgacatctcgctctaaaccgatatcgctcaaaccgagaccgcgggcgatttcttccaccttggaatcaatgacataaaaatcattgtttgtcagcgcgtcttgaatgacgccgacttcttcaagcagcttctcgagctcgtcgggatcagcctcgcccattttgttgtaaatctcgttcatttcctcttccatcgcaaataaataatggaatgcgtctttcaggacgtctcgaatggattttcctttttccagcacggtatgctgatcaaggtatccgacacggacgttttttgaccactcgacttttccctcatcaggttcaagctttccggtaataatattcatgaaggttgattttccttcaccgtttgcgccgatcaaaccgacgtgctcgccttttaacaggcggaaggaaacgttattaaaaatggcccggtccccgaaaccgtggcttaaatcctttacagataaaatactcatgtttacacctctatcgttatcaaacacgcacaatcggcgtgtaatattcactcttttgattataaaggaggattcggaatgttgaaaggtataggaaagaaaaagaaaaattgcgttccgggcgaggttttgagatactatggaatagatttcaggaattgaggagaacaaaatgacgcaaacttggccatttttacataatgcacaatcatttatacaagagaattggaatgcttccggctttcaaacgccaacccctgttcaagagcaggcagcccagctgatcatggacggaaaggacgtcattgcagaatcgccgacaggtacagggaagacgctggcgtatgcgctgccggtcttggagcggatcaaaccagagcaaaagcatccgcaggctgtgattttagcgccttcccgtgagctggtcatgcagatttttcaggtgattcaggattggaaagcgggctcagagctgcgcgcggcttccttaatcggcggggcgaatgtgaagaagcaggtcgaaaagctgaagaaacatccgcatatcatcgtcggcacgccaggcagggtatttgaactgattaaagcaaagaaactcaaaatgcatgaagtgaaaacgattgtacttgatgaagcggatcagcttatcctgccggagcatcgcgaaacgatcaaacaaattattaaaacgacattaagagaccgccagcttctatgtttttccgcgacactcaaaaaggaaacagaggatgtgctccgcgaattggcgcaagagcctgaggtgttgaaggtacagcgaagcaaggcggaggcagggaaagtgaaacatcaatacctgatttgcgaccagcgcgacaaagtgaagctgctgcaaaagctgtcaaggcttgaaggcatgcaggcactcgtatttgtgagagacattggcaacctgagtgtatatgcggaaaaactggcatatcaccacgttgaactcggcgttttgcacagtgaagcgaaaaaaatggagcgggcaaaaatcattgccgcattcgaagacggagagtttcctcttttattggcgactgacattgccgcacgcggtttagacattgaaaacctgccatacgtgattcatgctgatattccagatgaagatggctatgtccacagatcaggacgaacaggccgggccggaaaagaaggcaacgtgctgagccttgtgacaaaattggaggaatctaagctgaaaaaaatggcgaagaagcttggtgttgagctgagtgaagctgtgtatgcaggcggaaaactgaagacgaaataaaaagaagggcgaaaagccctttttttgttgtaaaataatagaaaaagtttcgcgcagggggtgggaaggtggtttcaatagacaggtttcaagcagtgaaggagtcagagctgaaaattcttgaaagctggtttgagaatgaggataccagacggagaatggatgggatgctgccattagatgaatggtatgcacgagtaaataaagataaacacgatactgtcatcatggcgtatgatggacagctgccggcagggatggtcgttattgagttcggggagaagcggacatatattggattgatcgtcaatcctttgtaccggcttcaagggtacggaaaacggatattgcaaaagctgatgaccgaacctgattttactagcgtgcgggaatgggtggcatgcattgaagaagacaatcgaatcagtttagcttgctttcaagcagcaggattcactttggaagatacagaacctgatgaagatggttttcttacgctgattcttcgcagctgatctcatcgaaacacaaaaggagggcaaaaagccctcccgttttcatcttcattcagctcggatcactgaccttgatcagctgtttccctttattttctcccttaaataaaccgagaaacgcgtcaggaatgttttcgaagccttctgtgatggtttcctcgtaatggagtttaccagccttcagccattcggccagctgttttgctccctcagaaaaacgatcggagtagtcgcttacgataaagccttgcatcagcgacttcgttttaatgagttttgattggacacgagggcccatgtcatctgcttcgctttctgcgttataggaagaaatggcgccgcacaccggaatgcgggcaaattcattgagcagattcatcaccgcgtctgaaatcggtccgccgacattgtcaaaatacacatcgacaccgtctggacaagcgttttgaagcgctttttggatatcatccgctgttttgtaattgatggcttcgtcaaactgaagctcctgttttaaatagtcgattttttcatcagaacccgcgataccgacaactcgcgcgcctttgattttggcaatttgcccgactgttgaaccgacggctccggcagctccggagacaaccacggtttcgccttccttcgggcgtccgatgtccagcaatccgaagtatgctgttaagccggtcattcccaaaatgccgagataggccgaagcgggagcaaggcttgtatcaatttttcgcaaggcagactcgctcacagcggaaaattcctgccagctgagatttccgatgacgatatcgccttttttcagatgattcccgtctgacacaacttcagcgataaccccgccagaaagcgcttcatccaaggcgaacggctcaacatatgacttcgtatcctgcatacggccgcgcatataagggtcaaccgaaacataaagcgttttgacaagcacttccccttgcttgggttcaggaaccggaatggtttcaaagcgaaagtcttcatgaacaggaataccttgtggacgtcttgctaattgaatttgctgctgagatgctgtcattttcatcctcctatcacttggttgacaccactgtaacatggacaggagaggaaatacaaaaggtaagctggcatacaaaaaaggagagggggctcctctccttttcatttcgcccgtaatttcgggcacagtcccgtcggcaggcacattggcttctggtcgatcgggcttctcatgatgcagcattccaagccgaagacttcacggaaaaatggctgggtgaacacatcttccggtgttccggcgttgtatatttttccgtccagcacactgattagatagtcagcgtattgagcggcttggtttaaatcatggagcaccatgacaacggtgcggccatggtcgcggttcagctttttcagcagttcaagcacttcaatctgatgtgagatgtctaaatacgtggtcggctcatcaagcaaaagcaaatcagtgccttgcgcaagtgccatggaaatccaggctctttgtctttggccgcctgagagggcatcaagtgtccgatccttcagttcaatcatgcccgttgcttccagcgcccactctaccatgtcatgatcctcttgggtatgcttggataacagctttttgtgaggatgtctgccaaaatagcataactcctctaccgtcaatccttcaggggcctgaggagattgtggaagaatggccagtttttttgcgacttcttttgatggctggcggtggatgtcttttccttctagtagcactgtaccgcttttcggggccatcagcctggcgagcgatttgaggattgttgatttaccgcagccattagcgccgatgagcgcagtgatttttccttcttctatctttaagtcgactccgtcaataatcactgtactgtcatatgaaagagtgagctggtctgcagccagttttcccatggtatcctctccctactgtttcctcgcttcgaatttcaataaatataagaaataaggcgcgccgatcacggctgtcagtattccggcaggtatttcaaccggaggcatgatgccgcgccctaacgtatctgcaattaataatataatagcaccaatcaatgccgatgcaggcagtaaatatttagctttttctccggtaagccgtctggcgatatgcggagcaagcaagccgataaaaccgattgagccgacgacggctacacagcttcccgccagcgccaccgcggtgaaaatcaggatgaatctcagccggtttgcgttttctccgagaccctgtgcaagctcatccccgagtgacataagatccagcttcggtatgagtatgcagacgatcggaaaaagaatcaaaagccatggcgcaagcaggttgacttcttcccagtttcttccccagaggcttcctgtcagccaaatgagtgcagcattcacgtcgcctggaaacttgaccatcatatattgcattccggcgtggcagaccgcgcctaaagcaatgcctgataaagccagtgaagagggctgaatgctcttttttcgggctatcattaataatagtacagcaataatggcggctccggcaaatgcggagaacggaagcacgtataccggcgactcaggaaagatgagaatcacagccatcgccgcaagtccggagccttttgaaatgccgacaacgtccggggaagcgagtggatttcggatcacaccctgtaaaatcgctccggcagcggcaagcccagcaccggccaaaatcgctaatataatgcggggaaggcgatattgctggatgataaattcaaaggaatgatccagtcccagcagattcgtcactaccgcatcaggtgaaatgtataatgcaccgattccaatgctgatgacggacagaacgattaaaatcacggccaatatgagtatcgccagtaaggggcgtttttgttttctggttgttttcttcatttcagatgtcgccctttccttgccaaatataagaaaaacggcgttccgataatcgcggtgacaatgccgaccggtgattcataaggaaatgcaatccatctggccagtacatctgcgtacaccagcaaaatggcaccgaacagtgccgaaaacggaagcacgtattgataatgttctccgatcagcttgcggacaatatgcgggacgagcagcccgacaaagccaatcggcccggcgacggctacggaagcgccggaaaggattaaaataatcaaactgatcagaatccggatgccgttcatattttgtccaagcccttttgctgtttcgtctccgagaccgagaacagaaacagaaccggaaaatacgagggcaagcccgatgccaatgacagaaaacggagcgatggttatgacgtcctgccagttgctgccgtcgattgcgcctgtcatccagtacagaacatcctcacctgactcatttaaaataatgatggcctgtgtcatagaggagaggaacaaatgcacggccattcctgacagcgccagcttaacaggtgtcattccgccggatgaggcaatcatatacacaatcgcgccgcctgctgccgcacccgcaaaagcgaatataacagatgaatagggcgatgccggcagaatgacgagagaagcaacgacaaaaagcgatgcacccgcattcacaccgaaaatttggggtgaagccagagggtttctggtcatagcctgcattagcgcccctgctacagctaggctggcgccgacaaaaacgccgattaatgtgcggggaaggcgaagagtagagatgatgagctgttcctttgaaccgtcccatacaaaaagatatttcaatgaatctatgatgccgatgtctgaggctcctactgaaagattcagcccaagcccaaatataaaaataatcagtgcaatgatgaacatcatcagtcttgatgatgagcgccgtttggctgattgatacaacagtctcacttccttactgcgtctggttgcaaaaacgaagaagcaaggattcccctcgcttctcatttgtcctatttattatacacttttttaagcacatctttggcgcttgtttcactagacttgatgcctctgaatcttgtccaagtgtcacggtccgcatcatagacttgtccatttttcaccgctttgagatttttccagagcgggttcgttttccactcatctacaatggttttgccttcgttggctgagatgaacaaaatatcaggatcgattttgctcaattgctcaaggctgacctcttgataggcgttatctgacttcacagcgtgtgtaaagcctagcattttaaagatttctccgtcataggatgatgatgtatgaagctggaaggaatccgctcttgcaacgccgagaacgatgttgcggttttcatctttcggaagttcggcttttagatcgttgatgacttttttgtgctcggcaagcttttcttttccttcatcttctttatttaatgctttagcaatggtcgtaaagctgtcgatcgtttcgtcatatgtcgcttcacggctttttaattcaatcgtcggagcgatttgtttcagctgtttataaatgtttttatggcgctcagcgtcagcgatgattaaatcaggcttcaaggaactgatgacctcaagattgggttcgctgcgtgtgcctacagatgtgtaatcaatggagctgccgacaagctttttaatcatatcttttttgttgtcatctgcgatgcccaccggcgtaatgccgagattgtgaacggcatccaagaatgaaagctcaagcacaaccacccgcttaggtgtgccgcttactgtcgtttttccttcttcgtcatggatcactctggaatccttagacttgcttccgccgcttccgttgttattctggcttgatgaacagccggatacaatgaggcaggcgagcaataaaacacttatgatggcaatcaacttgttagaataggtgcgcatgtcattcttccttttttcagatttagtaatgagaatcattatcacatgtaacactataatagcatggcttatcatgtcaatatttttttagtaaagaaagctgcgttttttactgctttctcatgaaagcatcatcagacacaaataagtggtatgaagcgttaccgtgtctttgagacaaaaacgcatgggcgttggctttagaggtttcgaacatatcagcagtgacataaggaaggagagtgctgagataaccggacaatttcttttctatttcatctgttagtgcaaattcaatgtcgccgatattcatgataatcgagaaaacaaagtcgatatcgatatgaaaatgttcctcggcaaaaaccgcaagctcgtgaattcctggtgaacatccggcacgcttatggaaaatctgtttgactaaatcactcacaatccaagcattgtattgctgttctggtgaaaagtattgcattagacatacctcctgctcgtacggataaaggcagcgtttcatggtcgtgtgctccgtgcagcggcttctctttaattttgatttttctgaaaataggtcccgttcctatcactttaccatggacggaaaacaaatagctactaccattcctcctgtttttctctttaatgttctggaatctgtttcaggtacagacgatcgggtatgaaagaaatatagaaaacatgaaggaggaatatcgacatgaaaccagttgtaaaagagtatacaaatgacgaacagctcatgaaggatgtagaggaattgcagaaaatgggtgttgcgaaagaggatgtatacgtcttagctcacgacgatgacagaacggaacgcctggcagacaacacgaacgccaatacgatcggagccaaagaaacaggtttcaagcacgcggtgggaaatatcttcaataaaaaaggagatgagctccgcaataaaattcacgaaatcggttttcctgaagatgaagccgctcaatttgaaaaacgcttagatgaaggaaaagtgcttctctttgtgacagataacgaaaaagtgaaagcttgggcataaagcaaggaaaaaaccaaaaggctatgacggccttttggtttttttgcggtctttgcggtggtattttgcagaatgccgcaataggatagcggaacattttcggttctgcatgtccctcaatttgctattatatttttgtgataaattggaataaaatctcacaaaatagaaaatgggggtacatagtggatgaaaaaagtgatgttagctacggctctgtttttaggattgactccagctggcgcgaacgcagctgatttaggccaccagacgttgggatccaatgatggctggggcgcgtactcgaccggcacgacaggcggatcaaaagcatcctcctcaaatgtgtataccgtcagcaacagaaaccagcttgtctcggcattagggaaggaaacgaacacaacgccaaaaatcatttatatcaagggaacgattgacatgaacgtggatgacaatctgaagccgcttggcctaaatgactataaagatccggagtatgatttggacaaatatttgaaagcctatgatcctagcacatggggcaaaaaagagccgtcgggcacacaagaagaagcgagagcacgctcgcagaaaaaccaaaaagcacgggtcatggtcgatattcctgcaaacacgacgatcgtcggttcagggactaacgctaaagtcgtgggaggaaacttccaaatcaagagtgataacgtcattattcgcaacattgaattccaggatgcctatgactattttccgcaatgggatccgactgacggaagctcagggaactggaactcacaatacgacaacatcacgataaacggcggcacacacatctggattgatcactgtacatttaatgacggttcgcgtccggacagcacatcaccgaaatattatggaagaaaatatcagcaccatgacggccaaacggatgcttccaacggtgctaactatatcacgatgtcctataactattatcacgatcatgataaaagctccattttcggatcaagtgacagcaaaacctccgatgacggcaaattaaaaattacgctgcatcataaccgctatcaaaatattgtccagcgcgcgccgagagtccgcttcgggcaagtgcacgtatacaacaactattatgaaggaagcacaagctcttcaagttatccttttagctatgcatggggaatcggaaagtcatctaaaatctatgcccaaaacaatgtcattgacgtaccgggactgtcagctgctaaaacgatcagcgtattcagcgggggaacggctttatatgactccggcacgttgctgaacggcacacagatcaacgcatcggctgcaaacggactgagctcttctgtcggctggacgccgtctctgcatggatcgattgatgcttctgctaatgtgaaatcaaatgttataaatcaagcgggtgcgggtaaattaaattaagaaagtgaaaaacacaaagggtgctaacctttgtgttttttaattaattaaaatgtttattaacttagttaaggagtagaatggaaaaggggatcggaaaacaagtatataggaggagacctatttatggcttcagaaaaagacgcaggaaaacagtcagcagtaaagcttgttccattgcttattactgtcgctgtgggactaatcatctggtttattcccgctccgtccggacttgaacctaaagcttggcatttgtttgcgatttttgtcgcgacaattatcggctttatctccaagcccttgccaatgggtgcaattgcaatttttgcattggcggttactgcactaactggaacactatcaattgaggatacattaagcggatttgggaataagaccatttggcttatcgttatcgcattctttatttcccggggatttatcaaaaccgggctcggtgcgagaatttcgtatgtattcgttcagaaattcgggaaaaaaacccttggactttcttattcactgttattcagtgatttaatactttcacctgctattccaagtaatacggcgcgtgcaggaggcattatatttcctattatcagatcattatccgaaacattcggatcaagcccggcaaatggaacagagagaaaaatcggtgcattcttattaaaaaccggttttcaggggaatctgatcacatctgctatgttcctgacagcgatggcggcgaacccgctgattgccaagctggcccatgatgtcgcaggggtggacttaacatggacaagctgggcaattgccgcgattgtgccgggacttgtaagcttaatcatcacgccgcttgtgatttacaagctgtatccgccggaaatcaaagaaacaccggatgcggcgaaaatcgcaacagaaaaactgaaagaaatgggaccgttcaaaaaatcggagctttccatggttatcgtgtttcttttggtgcttgtgctgtggatttttggcggcagcttcaacatcgacgcaaccacaaccgcattgatcggtttggccgttctcttattatcacaagttctgacttgggatgatatcaagaaagaacagggcgcttgggatacgctcacttggtttgcggcgcttgtcatgctcgccaacttcttgaatgaattaggcatggtgtcttggttcagtaatgccatgaaatcatccgtatcagggttctcttggattgtggcattcatcattttaattgttgtgtattattactctcactatttctttgcaagtgcgacagcccacatcagtgcgatgtattcagcatttttggctgtcgtcgtggcagcgggcgcaccgccgcttttagcagcgctgagcctcgcgttcatcagtaacctgttcgggtcaacgactcactacggttctggagcggctccggtcttcttcggagcaggctacatcccgcaaggcaaatggtggtccatcggatttatcctgtcgattgttcatatcatcgtatggcttgtgatcggcggattatggtggaaagtactaggaatatggtagaaagaaaaaggcagacgcggtctgccttttttttattttcactccttcgcaagaaaacggattttgaaaaatgagaaaatttcctgtgaaaaatggtatgatctaggtagaaaggacggctggtgctgtggtgaaaaagcggttccatttttccctgcaaacaaaaataatggggctgattgcggctctgctggtctttgtcattggtgtgctgaccattacgttagccgttcagcatacacagggagaacggagacaggcagagcagctggcggttcaaacggcgagaaccatttcctatatgccgccggttaaagagctcattgagagaaaagacggacatgcggctcagacgcaagaggtcattgaacaaatgaaagaacagactggcgcgtttgccatttatgttttggacgaaaaaggagacattcgcagcgcctctggaaaaagcggattaaagaaactggagcgcagcagagaaattttgtttggcggttcgtatgtttctgaaacaaaagcggatggacgaagagtgatcagagggagcgcgccgattataaaagaacagaagggatacagccaagtgatcggcagcgtatctgttgattttctgcaaacggagacagagcaaagcatcaaaaagcatttgagaaatttgagtgtgattgctgtgcttgtactgctgctcggatttattggcgccgccgtgctggcgaaaagcatcagaaaggatacgcttgggcttgaaccgcatgagatcgcggctctatatcgtgagaggaacgcaatgcttttcgcgattcgagaagggattattgccaccaatcgtgaaggcgtcgtcaccatgatgaacgtatcggcggccgagatgctgaagctgcccgagcctgtgacccatcttcctatagatgacgtcatgccgggagcagggctgatgtctgtgcttgaaaaaggagaaatgctgccgaaccaggaagtaagcgtcaacgatcaagtgtttattatcaatacgaaagtgatgaatcaaggcgggcaggcatatgggattgtcgtcagcttcagggagaaaacagagctgaagaagctgatcgacacattgacagaggttcgcaaatattctgaggatctcagggcgcagactcatgaattttcaaataagctttatgcgattttagggctgcttgaacttggggagtatgatgaagccattgatctgataaaagaggaatatgcgatacaaaatgaacagcatgatcttttattccataacatccattcgcagcaggtgcaggccattttgttagggaaaataagcaaggcatcggaaaagaaggtcaagctggtgattgatgagaacagctcactcgcgcctcttcctgcgcatatcggcttgtcccatcttattacgattattggcaatttaattgataacgctttcgaagctgtagcggagcaaagcgtgaaggaagttttgttttttatcacggatatgggccatgacattgtcattgaagtatcagacacagggcccggtgtgccgccagagaaaatagaagctgtgtttgagagaggctattcttcaaaggggatgaggagaggctacggtctggccaatgtgaaagactcagtgcgtgaactgggcggctggatcgaactggcgaatcaaaaaactggcggggcggtattcactgtgtttataccgaaggagaaacaaagggggaatccatttgattcacatcgcgattgcggaggatgattttcgagttgcgcaaatccatgagagattgattaaacagcttgatggattcaagattatcggcaaggcggctaacgcaaaagagacattggcgcttttgaaggaacacaaggctgatttgcttctgctggatatttatatgccggacgagcttgggaccgcgttgattcctgatatacgaagccgatttcctgaagtggacattatgattatcacagcggcaacagaaacccgtcatttgcaggaagcgctaagggcgggaattgcccactatttgatcaaacccgtaacagctgacaagttcaggcaggtgctgcttcagtataaagaaaaaaggaagctgctcatgtctcagccggaggtcagccaatccatgatcgaccatatttttgggaacagtgtgaagacagctttgccggcagagaatttgccgactggcattaattcgattacactgcgaaaaattaaggaagcgcttcagactgcgtcagaaggattgacagcggaggaacttggggaaaaaatgggggcgtcacgaacaactgcccgccgttatgccgagtaccttgtgtcaaaggaagaagcaagagccgagcttgaatacgggattatcggcaggccggagagaaaatattatttggcggcggattagatatgaaaaaatctataatcctattgattattctattgatctttactcagggtgatatcaggcaggcggctgcgccgcgcctgccggacgggccgatagaaattgtcgtccctgccgaaccttctggcggctgggatgtcacagcgcaggcgatccaatcagttttgaggcagaagcagatcgtgaaggatgatgttcatatcgtctataaatccggcggcgggggagagaaaggctggaaatatgtcaacaaaagcagcaaacaaaccatcagcatgacgtccagcttaatattgagcaatgatcttctcgggcaaagcaaattaaaaatggccgattttacgccgctcgccattctctccaaggaatggcagacggttgcattgccaaaaggatcagcgttaacaaatggcaaggatgtgctgaatgagatcaacatgcatcccggcaaggtgagaatcggctttgccccggggtttggcaatgatgatcagctctcgttcgtcagagcggcagatatgtacggcattgacccgtttgacattcaattctcacagtatgacagcagcgaacagctcattcaggcgctgatcagacatgagatagaagcggcttccatgaccctttctgaagcgaaaccatatgaacgaaacggcgatatcacgttagccgctgtaacatctgataaaagacttcccggttttccaaatgtaccgacgtggaaggagcagggaatcccgtttgttttttctcattggagaggaattttgggtccgaaaaatatgtctgaggaagagatttcttactgggatcaagcgctaaagaaggtcacctcttcacctgaatggaggcggaaaataaacgaacaggactgggaaagcttttatttaaacagcagggaaacgaaacggtttttagaagagcaatctgctttttatcaaagcatcatgacaggaaattaagatcccggcatccccgggatttttttcatgccgaaaattgatcaaaaagaacaaaacggttttaaaaaattaaaaatacaaaaaaaacaaattatttacttgcggttggttttcccatacgatggcaaaaaggcaagacaaaaaggggagtaagggagaaaaaaatgtaagcggattcatttaagggggaatggatgtgttagcaatcttaggctttctcatgatgcttgtgtttatggcattgatcatgacaaaacggctttctgttttaacagcattagttttgacgccgattgtgtttgcgcttatcgccggatttggatttactgaagttggggacatgatgatttcggggattcagcaagtcgcgccgactgcggtcatgattatgtttgcgatcttatattttggaattatgattgatacaggcctgtttgatccaatggttggcaaaattttaagcatggtcaaaggagaccctttaaaaattgttgtcgggacagcggtccttacaatgctcgtcgccttggacggagatggctcgacaacgtacatgattacgacaagcgccatgcttccgctctatttgctgctaggcatccggccaattatcttggcaggaatcgcgggagtcggcatgggaatcatgaacacaattccatggggaggtgcgacgccgagggcggcgagtgcgctgggtgttgatccagctgagcttacagggccgatgattcctgtcattgcaagcgggatgctttgtatggtggcggttgcgtatgtgcttggaaaagcggaacgaaagcgccttggtgtgattgaactgaaacagccagccaatgccaatgaaccggcggctgcggttgaagatgagtggaagcggccgaagctttggtggttcaatttattgttaacgctttctttaataggatgtttagtatcgggtaaagtcagtttaaccgtactgtttgtcattgcgttttgtattgcgctgattgtgaattatcccaatctcgagcatcagagacagcgcatcgcggcgcattccagcaacgtgctggctatcggttcaatgatttttgccgcgggggtgttcacggggattttgacaggcacgaaaatggttgatgaaatggcgatctcgctcgtgtccatgataccggaacaaatgggcggattgatcccggcgattgttgccttaacaagcggcattttcacattcttgatgccgaatgacgcgtatttctacggggtgctgccgattttatcagaaacagctgtcgcatacggtgtggataaagtggaaattgccagagcctctattatcggccagccgattcatatgctgagtccgcttgtgccatccactcatttgcttgtcggactcgtcggagtttctattgatgaccatcaaaaattcgcattgaaatgggcggttctcgcagtgatcgtcatgacggctatcgctctattgatcggtgcgatctctatttccgtatgataattcaggcgtaatgacacacactaacggcatacaacattccggaggtgtcattatgagtgatccttatatgccgctgacttcagtcagaagcggaacggggttcgaagcggcaaaaggggtgcacggcctgactgtgcaaattgcgaatgtctattttattcagctgccttctgaacctcactcatttgttttaattgatgccggcatgcctcaatcagccggcatgattgtcaatgaagccaaacaaagattcggtgaagggtttcagctgaaggcgattatcctcacacacgggcactttgaccatattggggcaatcgaagagatccttgagcattgggatgtgcctgtttatgtccattctcgggaaatgccttatgtaacaggtaaaaaggattatcctccggctcgtcctgacagcaagagcgggctggtcgctaagctgtcgccgctgtttccgcggcactccatcgatatttcctcacatgtccaggcactgccggaagacggttcagtcccttttcttgacgagtggatgtggatcgcgacaccaggacacacgccgggccatatttcgttattccgcgatgacggccgcgtgcttgtagcaggtgatgctgttattacagtggaacaggagaaaatggctgacgtcttgatacaaaaacaggagcttcacgggccgccggcttatttcacgcctgacacagagacggccgcggagtccattctaaagctggccggtcttgaaccggaagcgttattgacagggcacggcataccgatgaccggcaaaaactttcgaagtgacttaactgaattggcaaatcggttatcgtctatttgacacccgcaccacgcgggtgttttttattgttttccaggaagttgcagaaaaatcatttgtcttgccgcttaaaaacgatacaatgaaaagcatgaagtgatgtgaaggggagagtttgttggaagaaaaagaaatactctggaacgaagcgaaagcgtttattgccgcatgctatcaggaattgggaaaggaggaggaagtgaaagaccgtctcgaggacattaaaagtgaaattgacctgaccggaagctatgtacatacgaaggaagagctggagcacggagcgaaaatggcttggagaaacagcaaccgctgcatcggcagattgttctggaattcgctgaatgttattgacagacgagacgtccggacgaaggaggaagtgcgtgacgccctcttttaccatattgaaaccgccaccaataacgggaaaatcagaccgaccattacgattttccctccggaagagaagggtgaaaagcaagtcgagatctggaatcatcagctgatccggtacgctggatatgagtcagacggagaaagaatcggcgacccggcttcctgttccctgacagcagcctgcgaagagctcggctggcgcggagaacgaacggattttgacctgctgccgctcatttttcgcatgaaaggcgacgaacagcctgtctggtatgagctgccgcgttcacttgtgatcgaggttccaatcacacatccggacatcgagacgttttctgatttggagctgaagtggtacggcgtgcctatcatctctgatatgaagcttgaggtcgggggcattcattataatgccgcgccatttaacggctggtatatgggcacggagatcggagcgagaaacctcgcagatgaaaagcggtacgacaagctgaaaaaagtagcgtccgtgatcggcatcgccgctgattacaatacggatttatggaaggatcaagcgctagttgaattgaataaagctgtgctgcactcgtataaaaagcagggtgtcagcatcgttgaccatcatacagcggcaagccagtttaaacggtttgaagaacaggaggaagaagcgggcagaaagctgacgggggactggacgtggctgattccgccaatttcacccgctgccactcatatcttccaccgatcctatgataactcaatcgttaagccgaactatttttatcaagataagccttatgagtaaacaatagaaaatcgatgatggccttcaaggctgcgggattcagtcacagagatgtcggtaacctttgagaaagggcttccgttctttacagcctcaacaaacgattgcagggcgttttccggaccctctgccaaaatctcgacacgcccgtcatcacggtttttgacccagccggccagttttcgcttatcagcttccatttgaacaaaatagcgaaagcccacaccttgaacccggccgtctacaatgattcggtattgaagcatgtaaaaaccaccttttctttttatgataatcaatcattttacaacctgtaaaggggatgtgtttgtatgaaaccagagcgctattcagttctttctcttaatctgggaaaaccgcagacgcttgaatatgacggaaagaaaatcgataccggcatcatgaagcgtccggctgaatcagccgtcatgctgtatcgggagaattttgaaggagacggacaggcggacctcgtcaaccacggcggacctgataaggctgtctgtgtctacccggcggagcattatccgttttgggaagagttcctctcaagaccgctgtcaaatgccgcatttggagaaaatctgacggtcgcgggcctgactgaggagaatgtttgcatcggggatgtgttcaggcttgatgaagctgttgttcaggtcagccagccgcgccagccgtgtgtaaagctggcgaaaaagtttggtgtaaaagaaatggtgctgaaggtccagcaaaccggctatacagggttttattttcgcgtgctggaggagggcagggtgtctcccggcgcgaaccttgaattgctgtccagaggagagaagggcatatccgtccagttcgccaaccgcatcaactaccatgatgcaaaaaatctcaccgccattgaacggattttaagtgaggctgcactatcggaaagctggagagcgtcctttatgaaaaaaaaggacaggctgctgccggttgaatagaaaaaagccgcgcatatcaacgtgcgcggctttgccatatttaagattgttttttctttgtttcaagcaggttggcaagaaaataggttttatagctttgaagctttcttccctcatggtgcgtgatcccctgcttttttagttctgccacataccagcctttactgccgtaatgcatgtcagaaaactcctttccctatctgatttcgaaacgattggcattgtaacatctataaaaagatgctgaaaagagatgcggggaaaactgagcctttcgaactagatgtgcgaatgttcttctgtatgtatatgcggagcaaaagccgaatatgatttaatggccggttagtttgatcatgacaacgccaaatgtcataatggcgaaaacaatgccgatatatgtgagcatcccgttttttttcttaacgccgtaaacggttataatgatgccttcaatgaaaaaaatgatgccgaaaataataaaccacatgcagataaaggctcctttcacagacataatagtagtgtagcatatctgaaagagccgggctgtgataatatcaagaaagccgggcgcatatcgcccggctcatgttttattgtttatcaaccaatttgaccagaagctgtgccaaatgttctttctcatcttcgtccgcaacgctccaaagctcttgcagcagcatttcttcaccgttttgcggctcttcatgctttgcgaggtagtctcccaggatcgcagcgctttttacaagcttgccgtcatccaatcccagctttttgcctcggttgacttgttttttcaggtagcctttaaattcatcaaagtcttttaaaatgtcttcttttattgtgccatgcatcgcgttcatttcgttttcaatttggattttttcttgatctctgttcattgcaagacctcctcgtgcagaataatgatgttttacctgctattggaggaggttaaacctgccggaagcccggaatgtgttttacagtttcgtcaggataatcggttcatcttttgtgatgacgatcgtgtgttcaacttgggcaaccatgcttttatccggcgtcttgaacgtccagccgtctccagcttcaacaatcgtttctgctttcgttgaaataaacggttcaagcgcgatgactgtgccatttttgaacagtgcgttatcaaacggatcataatagttcatgatgtggttcggcgcttcatgcaggcttcggccgattccgtggccggtcagggttttgatgacggtaaagccttgagagcgtgcttcatgataaacggctcttccgatctggttttggcgcttgcccgcttttgcctgctgaagccccttttgaaaagcgttttccgcgcattggcaaagcttatgaaggcgttcttctccttcaccgagcacaaatgagatgcctgtgtcggaatagaagccgccaaattcagcggagatgtcgatgttgacaaggtcccctgcttttaaaattttggatgtgcttggtatgccgtgagccacttcatcatttacgctgatacatgtcacacctggaaaatcgtattccttctcaggagctgaaacggcgccgtgctcatcaagcacagcttttccgataaggtcaaggtcttttgtgctcatgccgggctctgccttccgcttcatttcttcacgcgcaagcgcgacgattcttccgatttttttcaggccttctaattcttgatcgtttgttacaatcatctgtcattcccgctttctttttaaataatctagattaagcttaccacaactgtcttaaaaataggaaacacacggacctgggaaaaaagaaatacccccgggaaaattggtatagatcactagatatcttatatggtatatttgaaaaaaaagggtatgaggggatgggtatgctttcatttttacaaaaactcgggaagtcatttatgctcccgattgcggttctgcctgcggttggaattatccttgcgcttggcagagaggatgtatttaatatcccgtttgtctatcaggcggggacggcggtttttgatcatctgccgcttatttttgcgatcggtattgccatcggcatttcaaaagacagcaatggggccgcgggtttatcaggggcgatatcgtatctgatgcttgacgcggcaacaaagacaattgataaaacaaataacatggcggtgtttgggggaattattgccggtttaattgccggttacacctataaccgcttcaaggataccaagctgcctgaatatctcgggttcttcagcggcagacggcttgtgccgattttaacagccattattacgatcattttagcgggcatattcggagtcgtctggccgccgattcaatcgtgtatcaactcgtttggagagtggatgctcgggctcggcggcatcggggcaggcatattcggccttttcaacaggctgttaattccgcttggccttcaccatgtgctgaacaatattttctggttccaattcggagaatataacggagtgacaggggatctggcgcgctttttcgcgaaagatccgacagcgggcacatatatgaccggattcttcccaatcatgatgttcggtcttccggcggcgtgtctggctatgattgtgactgcgaagccgtctaaacggaaagcgacggctggaatgatgattggatttgctttaacagcgtttatcacagggattacggagccgattgagtttgcatttatgtttttatctccgcttttatacgctgttcacgcggtcttaaccgggttatctttatttatcgtcaactggctcggcatccgttcaggcttctctttttcagccggagctatcgattatgtgctcagctatggaatcgcagaaaaaccgctgcttctgcttttggtaggtatatgctatgcggcagtatactttatcgtgttttatgtactgattaaggctttgaatttaaaaacgcctggacgggaagacgatgatgtggatgaagtgctggatgaaaatactgttcaggatgtaaatgaaaacatcatgctgaaagggctcggcggaaaagaaaaccttcaaaccattgatcattgcgccacaaggctgcgactgactgtgaaggataccgctttggtggatgaagcgctgctaaagaaagcaggcgcaaaaggggttgtcaaatcaggggggcaatcggttcaagtcattattggcccgaatgtggaatttgcggcggaagaattgagggctgctgtcaaataaaaaaagcggagagggcaacctctccgctttttcttatttatcttcgttatcctttgacgtttcggaagaatcttcgtcatgttttgtgtaatcataatcagaaggattcaccttcttaaaacctttcggctcgtagaaccgcagcaggtctccgtttatgattttatcggacatttcaagttccttcttgacgagcgagtcttctgacttgtcgacttcggattcatcgagttcttttccggttttcgtgtcgtaatacttaccggatattttcgtgtacttcggtgaaataaagtctccgtttcggaacggaatcacttcacggtgttctttcgataaaatatcagaaccggacatcagatagtccttcgtatccactccgagcagatgcagaatggtaggagccacatcaacgtctccggcatatttatgaactttctcgcccttcacgccggcagcgtggataaagagcggcacccgttgaagctgggcgttgtcgtaatcagtgatttcatccttgccaagcactttcgccatcgctttattgtggttttcagagatgccgtagtggtctccgtacatcacaataatcgatttatcatataacccgtcttttttcagatcattgaagaattgttcaatggactgatcaaggtaatgggctgactggaagtagttatcgacgacagagtcaccaaagtctccagccgggaagtctgtatccccctcatccattccgaatgggaagtggttagacagggtaatgaacttcgtatagaacggctgcggcaggctttccagcagcggcattgattctttgaagaacggtttgtctttcatgccgtagtttttcgtgttttcttcgttcatgtcatagtaagcagaatcaaagaatttatcaatgccttccgccttgtacatttcgttacggttccagaacgtctgcgtgttcccgtggaaagtagcagatgtgtaattcttagacttcagaatcgccggaacggattgcagcgtgttttgcgctttgtttacgaaaactgaaccttgagccagcgggtacagagagttttccatcataaattcagcatcagatgttttaccttgtcccgtttggtggaaaaagttatcaaagtagaacgtttcgttatcatgtgccagtttatttaagaacggtgtcacttctttgccgtcaattttatagtcgatgataaatgactgcaaagattcaagtgaaacgtaaatgacgttttttccttccgctttgccgaaatacacgttattcggcacatcgtaattggctttcatgtagttttccacttccgtcacgtcgctggaatcggcaagcgcgcgctggctgttggacttgatattctgtacagcgtcataaatcgtgaaattgtatgttcccaagtatttcacaagatagttccggtcgaatgatcttgtcagcaattcaggacggtctgattccgcaactgccagattgatcaagaacacaagaattgaagacgcaaaaataattcggaacgattttttgcttgacgtttcggcaggcttgtttactttgatcgccaagatgatcaggatgatcgtatcgataaagtaaaaggcgtcagtcggtctcatcagcgaaaatgcgctgtcaccgagttggccgccgtttgttttagcctgcataatgaccggaattgtaataaaatcattgaaaaatctgtagtacacaatgttggcgtacagtaaaaaagacattaaaaaatgaatcactataatggctgtctgctgtaattttttcttgaacaagagtccaaagccaagaaagaacaagcttgagctaagaggattcacaaaaagcaatattttttgtatcgtgttgtctattcctaagttgaagttcaggacataaccgacatacgttttgatccataacaggacgaccgcgattaagaagaaggccagtcctctttcttttataaatgttttcattgttacactccttttttccgatccagttcgagcgaaacgatagaaaaaacgaacgtatccaatataacacgaatcagcagattagaaaagtgaaaatcgtatgatggagaaagtggcgaaaaacgccgtcgaatcaacgtttcgctttgatattaccaaatgtaaaacaaggtatctttctagaaatagaggaataaaatggtacattgggaattgtatgataaaatataaggtatagataaaaagaggtgaaatgatggatttttcccatattgtgtctgaagataaaattaagcgcgccatcaaagacggggactttcaaaacctcccgggaatggggaagccgctgccgaaggatgacgcggcacacttgccggaatcgctgcgcatgggctatcgtattttgaaaaacgcgggaatggcagaggacgagggcgcgctcaaaaaagagcttatgaccatcgaccatttaatcgaaaagtgctatgacgaaaaagaacgcgagcaattaatcagaaaaaaatctgaaaagcaattgctgcttgataagcttgtcgacaaaaaaggcatgttttcaaagccagcatccgctttttataagaataaagtatatgatcggcttggacgaaacagaccttcttccagctgatttgtcttgtctgcaggatggcgattgataatagccatcctttttatgttccaagttctatgtcaaaaggtttatgtttttccatctatgggaaatgattcataaacgaaaaaagggtgatgggatggaacgactattagtatggatagagcatatatctgattggctgtggggtccgccgctaatcatcctgctgacggggacgggcttgtatttcactattttgctgaaaggttttcaatttcgctatcctttatacattttcaaacagacaatcggcagcgtaggaaaaaagccgaagggagagggcacagtcacaccgcttcaggcattgacctcagccctcagttcaacgatcggtgcagcgaacattgtcggtgtgcccgccgctattatgtttggaggaccaggagcggttttttggatgtggcttattgccttatttgccatggcgattaagttttctgaaagtgttcttgctgttcattacagagaaaaaaatgagcagggtgaatacgtcgggggaccgatgtattacataacaaaagggctgcgcatgaaatggctcggcgtattcttctctgttgcgctgattgtggagctgatcccaagcattatggttcagggaaattcggtttcagtctcgcttgccgagacgttttctttcaataaaatatacgcaggaatcggaattgcatttttgattgggttagtggtgataggaggggtaaagcggatcggaaaagtaacagagtttgtcgtgcctcttatggcaggggcatacgcaggtgccggtctcctgattgttctcatgaatctatcatcagtgccggcgtttttctctctcatcttttcaaatgcgtttacctcttcttcagcagttggagggttcgcaggtgctgcgttggcggaaaccgttcgctggggatttgcccgcgggctgtattctaatgaagccgggatgggaacagccccgattgcacatgcggcagcaatgactgatcatcctgtgcggcaagggttttggtctgtgatcggcattgtcattgacaccttgatcatctgcacgaccaccgcttttgtcgttcttgcatctggtgtctggacagggaagaacgcctcaattgacccggcagcactgacgacggctgcatttcagcattatttcggttctggcggagggtacttcgtttcggtttccctagtcttctttgtcgtatcaaccattatggttgtcattttttacggcgtaaagcaagctgaatttctgttcgggcggctggcaggacacgtgattaaattcgtttatttagcggctattatcattggtgccgcaggcggagcaaaagccatttggggctttttggacttagcattggcttttattctcgttccaaatgtgattgcgctgttgttattgagcagaaaggtaaaagcgctgtacaccgaattctttacatctgaacagtactacctgaaagatataagaaaaacaaaacagaatcctgtttatcaaacaaaagaaactaaaaattcctagtgctttgctttggcgctgaacaacgctttgctttttatgatcaaataaatgagtaaaggcagcaaaagagaaatcactacattaatgattggtttgattctgttaaagtcgattagctgatttgtatttaaaaagaaccaaaagccgcatacgactgagaacatgccggttggtgtatacatggctttcgggtcgatttttgagtgtaaaaacgaaaggccgtataccacgatatatagggaacctgctatcttcaccataatgactggaatccaaaaagccgcgatgatcaggtctgagcgatccagaaaatccgtaatgcggatctgcctgatgaccatataagcaggatcaaagaaagtagatgtcaggttgggaccaaagacagaaattgaagaaaataacatcacggccagcaataaagcgcccagcagtatcgcgaaaatggtgtattttagcgggacgctccggtttgagaagagaagcggaaggataatcaattcccccattgtcccaaacgcgtaatagcctgattgaaggtatgggattagaccttcaaaaacaggtgtcaagttttgaagctcaatttgtgtggccagcgtaaatggaaggcacaagaccaggatgccgaatggaaataggaatatctgcgccattctggtcaatgtttcttttccctctctggcaatacagatcgccacaaagataataacaccgccaagaacagccattggtgttcttgggagaaataaaatgttaatcaaattgatgaaaaaacgtatatcatgagcattgattaacaggaaatacaaagaaaacagtaaaatgataatccggcctgcgattggtgaggaatcgctcagcagctcatagatatttttatcctgatgctttttcatcagcctatgcatgagccagagtgccggaatcacgaggacaacgccgaggatgtagctgtgccaggcattttgtttagctgattcgatcatgagaatcggagcatgctttaatccgactgctaacgtatacagagctccgaaaaataatccttggtatgcagaggtcttgtccataaagcacatcctttctgtcatgttcaaaacggaatatatttaaacaggtgccccagccgcggaagcaggggattcactctcatataaatccatagaaaagcacttcctgcaatcagcaggctgaaggcccattttgttagattgttagcggaacgaaaattcttccattcatatgcgtatatggcaatgcacacaatcaatgtctgtacgatatagctgatcatgctgacgcacctccattaatggctgatcgttttgtataggacaccgccctgctcaatcgtcacaattgggacgacgtgaacctccatatccttatatacctcttcccattcctttttcagcagattcttcgtggttgccgtgcttctgatggtcctgtcttgaaagccggccgggtccgcctttagcttttgcaaacgatgaacggtgctgatcacgtccttctttatggttctgtttagtgctttttgaatgatgtaatactggtcattttctctcgtctcataggttgattggttttccataataattcctttggctctgatctcgattgtcattgacagctttccgtttttttcagcggcatgaaaggatacattggacttttgaagctgaatggatgcttgtcccatttgattcggcaggtctactatgaattctggctggcgggcttgattcagcaacatcagggctgctgtcatgtgtacatctttgaaaatatccatcaatctgtcctttttaaagatcgcaagcccgtcaattttcaaattagatttgcctttccctccaggttttgttttagatgcagagatgaccggtgcatacggatcactgcctatttctactagatcagacatgaatctgcttaagaaaacgggccggctcgttgcgataatggccagctcccgaatcatttccgccggaaactgttcaagctgaacatcggtgtttaaaatgtcccgcgcttctccccggctgactaaaatgagcgccgttaatctgttctgcggatttcgcgttaaaatatcaaagactggggcaacgccgtctctcgccatatcctctccaataatgactgtacgtctgtgggacgtattgattgtccgtgacaaggaggtttgcagcttgttgttcgcttctctgatcgtagtgccggaagctgaatcaacataccatgtttttgaaccggcagttccgccgccgccccctgtttgtccgcctaattgaccgaccaagggaatctgcatggccactcgatactgatcttttttcttatcaatggctgagctgacaacaaatgcaatgtcattgatttctgtccggtcccagcaccccgttagaaggatacaaatgagaagcggcaaaacacacttatatattgttttcttcatcttttgggtcctctcttttcgctcccttctgtccgttgccgcgcgaatacgtgcccggccttctggtcatcgtccaccaaggcgccctgacaaaaatatcttttacttcatctcgtttaaacggagaaatcccggataaataaggaataccgaaagattgcagcttgcataaatggagcactaagataatcgtgccaagcataatgccgaaaatcccgaaaatactcgccaaaaacataagcgggaaacgaagcatcctgatggagatagctaagttaaaccgcggaattgtaaatgacgcgatccctgttaacgatacgatgatcaccatgggggcagacacaattcccgcttcaacagcggctgtcccaatgactagggccccgagaatactgacggtctggccgatggttttcggcaggcgcactcccgcctcacggagagcctcaaaagaaatttccataatcaatgcttctatgatggcggggaaaggaatcggttcacgagcggaggccacactgaacattaagtttgtcggcattaagtcctgatggtatgtaataacggcaacataaatagccggcaaatataaagcaacgaataaaaacatatagcgaagccagcggattaagttagacatcaaataacgctcatagtaatcttcactggcctgcataagctgccaaaacgtaatcgggcctgttaagacaaagggcgtattatctgtgaaaatggcaaatcggccttcgagaagctgggcggcgacagtgtccggcctttctgtgtattgcagctgggggaatggcgagtacgtgtcgtcttcgataaactcttcaatatatccgctttctaagacagcatcaatctttatctttttgattcttttttttactttgtcaatgacctttggatcggcaagcccgtcaatataggccaagacaacatcggttttggttttcgtgccgattttaaacgagatcattttaagctgaaacgttttgacgcgaaagcgcacaagagcggtattgaccctgaggctttcagtgaagccctctcttgaccctctgatggtcgattctgttatcggctcttcaatgcttcttctttgtccgccttttatatttaagatcaggccttttgagtgcccgtcggcaaataaaaccgcgttcccctcaatgatagatgcagccactttactcatactcgtttctgttgcaacacttgaaattgatagagtattttgcagcgcctcttcatgttcatctatttgatccgtcaaatgcgttaagaaagggcggagggcgtgatcctgaatatgttcagattttacaattccttcgatataaacaataaatccgcacagcccgtttccaaagtcaaattgtctaaatacgatgtctgagcagccttctgttaataaggtcagattatcgaggttttccttcaaattgggagagatcggtctgtcctgattgtcttcaagctctttgatgagctgaagcgctttgtcgcgtttattcatagaggctcaccctgctttttaatgtcatattcaataagtgcttgtgacttttagggtaaccttgtctgtttcatatattccagactaggatgaaagcgctataaaaaagtgttgactacctgtatatacaggaatacaatatgattataagttgtatatacaagttataaaaacggatacggaggggttggcatgggggaactgaacaaatcggcacgtcagattgtcgaagcagtcggcggtgctgaaaatattgcagcggcaactcattgtgttacacgtttgcgttttgctttaatagatgaaagcaaggttgaccaagagatgcttgatcaaattgatgcggtaaagggatcattctcgacaaacggacagtttcaggtcgtaatcggccagggaactgtcaataaagtatatgctgaactggttaaggaaacggggattggcgagtcaacaaaggatgaagtgaagaaggcctcagaaaaaaatatgaatcctttgcagcgtgctgtgaaaacgcttgcagacatttttattccaatattgcctgcgattgtcacggcgggtcttttaatggggatcaataacattttaacggcggaaggcattttcttcagcacaaaatcgattgtgcaggtttatccgcagtgggcggatcttgctaatatgattaacctgattgcaggcacggcctttacgtttttgcctgcgttaatcggatggtctgcagtcaagcggttcggcggcaatccgcttctcggcattgtgctcggggttatgctcgtgcatcctgatttgctgaatgcgtggggatatggcgcggcagaacaaagcggagagatcccggtatggaatctattcggcctagaggtgcagaaagtcggctatcagggccaggtgctcccaattttgcttgcttcttatatgctggcgaagattgaggtatttttaacaaaacgcacacctgagggcatacagctgctcgttgtcgcaccaattacgcttctcttaacgggatttgcctcttttatcattatcggcccgattacatttgcgatcggtaatgtactgacttcagggcttatctcggtgtttggttcttttgccgcactgggcggtctgttatatggcggtttctactcagcactcgtgattaccggtatgcatcacacgtttcttgcagtcgacctgcagctcatcggttcaaagctcggcggcacctttttatggccgatgctggcgctttctaatatcgcacaaggttcggcggctctggccatgatgtttatcgtgaaggatgagaaacaaaaaggcctctccctcacatcagggatttctgcttatcttggcattacagagcctgccatctttggggtgaatctgcgatacagattcccgtttatcattgcaatggtcagctctggcctggccggaatgtatatttcttctcaaggtgtgctggcaagctccgttggtgtcggcggcgtgccggggattttctcaatcatgagccagtactggggcgcgtttgcaatcgggatggctattgtattgatcgtgccgtttgccggaacatacgcgtatgcgagattcaaacataaataacaaatggggagcgggacgtgttgaacgttcccttttcccattttcaatttaaatatggtggtggagacagatgaaaacagaacaaacgccatggtggaaaaaagctgtggtttatcaaatttatccgaaaagctttaacgatacgacgggaaacggtgtcggcgatttgaacggcattattgaaaagctggattacttaaaaacacttcaggtggatgtgctttggctgacgccgatttatgattctcctcagcatgataatgggtacgatattcgtgattattactcgatttatcctgaatatggtacgatggaggattttgagcggctagtgtccgaagcacataaaagagacttgaaagtcgtcatggatcttgttgtcaatcatacgtcaacagagcacaaatggtttcgcgaggcgatctcttccatagacagcccgtatcgtgatttttatatatggaaagacccgcaggaaaacggttctcttccgacaaactgggaatcgaaattcggcggctcggcatgggagcttgacgaagcatcgggccaatactatttgcatctgtttgatgtgacgcaggctgatttgaattgggaaaatgaagaggtcagaaagcatgtctatgacatgatgcatttttggtttgaaaagggaatagacggctttaggcttgatgtcatcaacctgatttctaaagatcagcgctttccgaatgcggaggaaggcgacggccgctctttttacactgacgggccgcgggtgcacgaatttctgcatgaaatgaacgaaaaggtgttttcacattatgacagcatgacggtcggtgagatgtcttcaacaaccgtagaccactgcatccggtatacgaatcctgacaataaagaacttgatatgacattcagcttccatcatctcaaggttgactatcctaacggcgaaaaatgggccttggcgccgtttgattttttgaagctgaaggagatcctatctgactggcaaacggggatgcacgcaggaggaggatggaacgctctgttctggtgcaatcatgatcagccgcgcgttgtatcaagatatggagacgatggcgcatatagggtgaaatcggcgaaaatgcttgctacggccattcatatgatgcagggcacgccttatatttatcagggcgaggagctggggatgacgaatccgaagttcactgacataagctcctatcgggatgtcgaatcgctgaacatgtataacgcctttaaggaaaaaggaatggctgatcaagatattacagccattttacaggcgaaatcccgtgacaattccagaacccccgttcagtgggatgctacggaaaatggtggttttacaacgggcacaccatggataccggttgcaggaaattaccgggaaatcaatgctgaagcggcgctgagggatcagaattcggtgttttaccattatcaaaaattgattcagattcgcaaaatgtatgacattgtgacagagggtacgtatgagataattgcaaaggatgacccgaacatttttgcgtatctcagacacggcagcaatgaaaagctgctcgtgatcaataatttttacgggacagaggcggcctttacactgccggactctttagcgcctgacgaatggaaggcagaggtgctgttgacgaacgatgaagcaagggaagggcttcagaacatgacgcttcgcccgtatgagtccattgtttatcgtttaacgaaaccgtgttaaactaagctgggtggtccataatgaaggtgaataaattcatcacaatttataaagacatcgcacagcaaattgaaggcggccgatggaaagcggaggagattcttccgtctgaacatgagttgaccgcacagtacggtacatcaagagaaacggtccgaaaggcgcttcatatgctcgcgcaaaacggttatatccagaaaatcaggggaaaaggctccgtcgtgctcaatcgtgaaaaaatgcagtttcccgtttcgggccttgtcagcttcaaggagctcgcgcaaacgcttggcaaagaaacgaaaacaactgtacacaaattcgggctggagcctccgtcagagctgatccaaaaacagctccgggccaatctagatgacgacatgtgggaagtcatcaggtctagaaagattgacggggaacatgtgattttggacagggattattttttcagaaagcatgtccctcacctgacgaaagaaatttgtgaaaactccatatatgaatatatagaaggagagctcggtctttcgatcagttacgcccaaaaagaaattgtcgccgagccgtgtacggacgaggacagagagctgctcgatttacgcggctatgaccatatggtcgtggtgagaaactacgtctttttggaggataccagtttgtttcaatatacggaaagcagacaccgtctcgacaaattccgatttgttgattttgcgcggcgggggaaatgagagaggcgcctgcctgcggcagcgcgcttttttgtttggtatcaaaattgatactatccaacaaaaatgtgcgtacttttactttttatcataatggctacaatagagatgtgagtaatctaaaggagaggtgttttacatggcagatctaaagacacaaattctggatgcatacaatttcaggcatgcgactaaggaatttgacccgaataaaaaagtgtcagacagcgattttgaatttattttagaaacaggaagactgtctccgagctcactcggccttgagccttggaaatttgtcgtcgtccaaaatccggagttccgcgagaagcttcgtgaatacacatggggcgcgcaaaagcagctgccgaccgcaagccatttcgtcctgattcttgcgcgtacagcgaaggatatcaaatataatgcggactacatcaaacgtcatttaaaagaagtaaaacaaatgccgcaagacgtgtacgaaggctatttaagcaaaacagaagaattccagaaaaacgatttgcatttgcttgaaagtgacagaacattgtttgactgggcatcaaaacaaacctatatcgcgcttggcaacatgatgactgccgctgcgcaaatcggtgttgattcctgcccgatagaaggcttccagtacgatcacattcaccgtattcttgaagaagaaggccttctggaaaacggaagcttcgatatttctgtgatggtggcatttggctacagagtgagagaccctcgtccgaaaacaagatctgctgttgaagatgttgtgaagtgggtttaaataaagaaagctgctcgctaagcgagcagctctttttttatgcctgattcgctctattctgttttctcctctgatgtaagtacattgccgttccgagtgcgctgataagaaatccggccaataggatcgagtacatggatgtggctgtgtccggaagcaggccgccagccggaccgtctgttcctgatccgcccgaaccgtttcctccagagccgttagtcggttgagtgccaggaggcgtatcatttcctccgtttccgtcagttggctgttttccgcctggtttgtcggagccgccgccatgattgccgtcatcaccgcctgtcggttggtcggacgggaatgccggcggtttgttgttcgaaccggaatttaagatcgtgtattcgctgaagtggtttgtatatcctgtcaccatatcatcgtcaactgatccgttatctgtctttgtgaaagctttctttttcctgtcgacatgataaatggcagggttatgggcttcttcaatatcaaacatgcgaagcgaaagctgaacgggctccttgaatgattttatttcttttcctttttgctttactgtaaagtcatatacatctgccaatgacacattcaattctcccgtcgacttgattccgattgcagtgtctgcagttttaaggttcgccattggcatcttcatgctgtaccagtagttgaacaccgtcaatgaaggatctgactctctttctttcaaaagtttgacctgatctttttttactttgagattgataggcttctcttgagatccttcatgtgttccataatagacaaatggcgtgttggcatttttagcgtaaatcgcaaatttgtcttcatcaagtgtccagctgccgtcctcctgctttgtcggcaggaatacttctttgatccgtccttcaactttaggagagaccttgtttcctagttttttcagctgttcggtgaaaatctcataatcaacgtagccaaggtcttcaccatgggaggcttctgtaaagacagaatatccgtctcctccggcaccaacaaaattatttgttgccacgcggtaggtatcatccgtatttatagcaactttgtctccgttaggcgattcaattttcacttctaacacacggtgtccaggtttgttgtttaatgtaaaggtatattcgattccggccacctgagggaaagcgccgccgccattttccacattgcttaggccttgttcaagggcttctttaatttgttttccggttaaatcggccacgtaaagcgtattgccgaacggcatcacgttgagcacctcgccgagtgtgatatcacctttgtcaatgcctgctctgatgccgccgccatttgttatcgctattctggcgccggctgcttctttcgcttttgccagcataccgtccgcgatgaagtttccgagattcgtttctttcgtgcgcacatgctcacgctggccgtcaagcgccacatccgtgtagccgactttttcattttttacgtcctctaattcatttttgaactgatcgagctcttgttttgcttctgggttttcttctgtatgttcatcaattggcagcacgctcagatttgatttatctgtttgcacaacgcctttttcatcaaacgcgacatcaacgcgccccaagaattggccgtattcttttgcctgtgccacgatcgtcggttcttcgttgtttacgacctccattttgtcaacgagggtgtgagtgtgtccgccgatgatcaagtcaatgccttttacttttttggctagctcaagatcacggttatgaccgatatgggttaaagcaataattttatttacctgttcttcttcctgaatcgctttgacggtgttttgggctgtttcaaaggcatcattgaatacgatgcttttgcccgggcttgatgtggtggctgtatcttctgttgtcaggccgaatacggcgactttctccccgtcaacgtctaacagaatgtaaggatggatgccggcctccttcttttcacctgccgtaaaggtttgcggctttttgacaaatgatttcagcttggactcatttgtcacatctacgtttgcactgacaatcggaaattccggcgcttcaaagtgatagcggttcgccggatcaacggttgcgctgtttccgcttagaaaatcagaaagcactgtcgggcctttgtcaaattcatggtttccgaaggtcatggcgtcatagcccatcatgttcatcattttcagatcggccaaaccgttccatttagtaaaatacagatcgccggaaaacacatctcccgcatcaaggagaatattgtgatttgtttcgctgcgtacttcgttgattttcgtcattcgtctcgctgcatcatcgagatgtgcgtgcgtatcattggtgtgcatgacggtcaggtcccacagtccgtctttaggaggatctggatttgaatcatcatcgaattgcagcttatacacaccatagccttcattcgcagacttgcctacataagcgacatcgtctgctttatcggcaaatggcttggccaaaagcgaggattcaaacgtcagattcgtgccggaaacaggcgcgattgaccagttgttgtctgcttttggattgactgttttttgttcaataatgtaatccatcagcacctgcctgttttcaaccgcagagccgtggacaattttattgctcgtcagatgagggaacccgccgcctccggacgcacgatagttattggtgactacgagaaattcctggcttgggctgatcggcttgccttcataggaaaggttgatgatacgggatgaatccgcattgatcacttttccgttctcattgtatttagccggttttgtcacatcgacctgatatgtgacaccgtcaatcacgtcaaaattataggaacggaaattctcgttcagcaaggcctgatcgccgcctttggctggatcaatttgattgaattggcctgccgacatctccagccagtccttcacttcgctgcctgtcagcttgacgatttgaacagtattatcgtaaaggtacaagtcaccgacatttttaatcgcaagatctccggctggaatgtttgtatagtaattggctccatttctgccgcctgctttaaacggcgctccagcggataaaatcggcaggttcttgtactcggtatccttcatttctttttcggcataccatttttgcgcgtcagtcacgatctgaatggaaggatcatctttgacctgtgcaaagaagctgttaatatctgcttcggttttgccgactggctttcggacatactccagtgtgttttggtgtgtttgctgaatggtgtttgtaacggtttcgtttcttgatgtgacgttgccagcaatagattcaatacttcctttggaatctgctaccttccatgagccgtccgccttttcaagcttgaggtcaatcacgcctaaatatttgccccagctgcttggcatgacgacaggaatgccgttaattgttcccttttccacatcaaattgagcaacacccgcatactcggaggaaggaaagagtccgtgctgatggcccgagataatcgcgtcaatgcctttcgttttagtggcaaggtcaaacacggcgttttctgcgcctgatgattgtgactgcttttcaatgccggtgtgggcgagggcaataatgacatctgcgccttccgccttcattttcgggatcgtttcattggcggattctacgatatcctgcacctgaacttgcccctcgagattctttttgtcccatgtcatgatttgcggcgggacaaagcctatgtagccgacttttactttctgctcattaccgttttcatcaatgagggttttttcattaatcatatacggcgtataacggttttcgccgctagttgttttgacgttggcatttacaatcgggaaatcggctcctttgattgtgccgtcgagaaagtcgagcccgtagttgaattcatgattgccaagcgttccggcgtcgtatttcagcgcattcatgacgctgataatcggatgggttttcgcgccggagataatatcgtctttttgatatttcaccgcgtattcacccagcggattcccttgaatcaagtcgccgttatccacaagaagggtgttagggttttgcttgcggtgcttttggatcaattgcgctgttctcgccagaccgaaatccgccgtttctttgtcgctgtagtaatcgtaatccatcatgttggcatgaatatcagtcgtagccaaaatactcagatgcacctgaggagccgcgctttcttctgcatgaatgggtggtgttgggaggattaggctaagtatcataattgggggcaaaagaatacggagaatgtttctgacgtgtgttcgtcttttctgtattctcaccagttctccacctttcaacgaaatttgtgttacagctcctattgtaagaatattttgtaactatttgtaggtgtttctttatgattattgtaaaagggagaaaaatgagtattatgtatcagtatcaagcgacaaatactgggtatttatgcttatcgtttgtcacaatcgcggaatgtttattttagtgtggctggggtagagtgttttatgtagacatataaagcgggaggttatgaatcatggggaaaaaaattgcagttgttttaacagattattttgaggacagcgagtacactgagcctgcgaaagcttttaaagaagcgggacatgaactgactgtcatcgaaaatgaaaaaggaaaaacagtaaaaggcaagcagggaaaagcggaagtgacggttgacgcgtccattgacgacgtaaatccttcagactttgatgcgcttttgattcctggaggattttcaccagaccagcttcgcgctgacgatcgtttcgtccaatttacaaaagcgtttatgactgacaaaaaaccggtattcgccatttgccacggcccgcagcttttaatcaatgcgaaagcgctcgacggccgaaaagcgacgggctatacgtccattcgtgttgacatggaaaacgccggtgccgacgttgtggacaaggaagtggttgtttgccaggatcaattggtcactagccgcacaccggacgatataccggcatttaaccgcgagtcattggcattgcttgagaaataagaaaaaacggacgcccacgggcgtccgtttttttgttgcttaggcttgagcacctgtcagtttcttgtacctgtaatacaagaaagcagctgcagccgttccgatgaccgcaatgccgaagtcgaatatgaaaatatgagcgatgccccccgcttttgcgataagccctgttgcaatcggcagcagaatcgatgcaagacttgaagcggtcgctacaattccggtaacggttccttttcgcttccagaaaagctctgtcattaacgtaatggtaatttgaaacacacccgcagttgaaaagcctaagaaaaaggcagtgatgtccagcacaactgggatatgaacggtcagcatgactgcgagcgtacataaagtaataataggatataagagcgttatgaagacaggtttgacccatctattcagcaaaacggctaataataaaacagatgccagagatcctatactataatagctcagcaattgtacagatgctgattcagctaaaccggctgctttttgcgcgtagctcgggagccagatttgagaaaccgtaaataaagccgtggatgtaaaaccgatgataatcagtgcggtgccttctttctgaaaaacgggttcagacaagaaaacgggagattcctgttggccgctattagttggtttcttatgttttttaggaaacgaaagcgttgataaataaataatattcaggagatagaccgctgccggcagataaaaagcaaatccgtaaaacatgctgtggtctgctaaaaatgtgatcaaaagcggcaaaagtgcggccccgacagacataaaggccttgaccaagacattcgccgaaccggaagcagtcggaaagagctcagttagggccggatatgttccggcatccatcgctgaatttgcgactccggctaataaggcgaacacaaacgccagctcatagctcggtgataaaggaataccgactaaaaagacggccataattcccgcagaagcgacaacaagcggctttctgccgattttatctgatagaactccggaaatgccgtatgtcagcagtttgccaaacccgatagcggcaatgacataactgatgccggtcggatcggtattccactgttttgttaatgaagacatattggatgcgagaatgatgttgaccatccccagaaagaagtagttgatatacattccggatgctgttttgatagatgtcgtttgcatgcttgtactccttcaaatcttattcgaacactttgctgttttggtttggggaaatgataaaaaagactcgccgagtttccggccagtctccattatttacgaagcgaggctaattcttgagcaatcgcctgcatttcacttgggctgaatgattcttttttcatcaccatgctgtgaaggtacgtgaggtcttcaatcttctcatcactgaaatcctccgctttgattacgccgacgttcagcatgttcagcttttgggaaatctcttcaatcatttgagttaatgtttctgtatttgggctggacaaatggttccatcctttctatgcgcaatataggtatgttttattctaacagaattccatcagaaaaaaaccctattctaaaagcaggctgttcattccaaaaaagtgaagacatcagttgaaaagaaaatgaacatcctactaagatattcatgaaggtttctttttagagaaataggggcaaagaatagggaggttggacaacatgataagcgtgttatttgtttgtttaggaaacatttgccggtctccgatggcggaagcgatttttcgggacctggcagccaaaaaaggattagaggagaaaatcaaggcggactcagcgggaatcggcggctggcacatcggcaatccgccgcatgagggaacgcaggagatattgcgcagagaaggaatcagctttgatggcatgctggcgcgtcaagtcagcgaacaggatctggccgattttgattacatcattgcgatggatgcagaaaatatcggaagtctcagaagcatggcgggatttaaaaacacttcacatatcaaaaggcttttggactatgttgaagattcagatcttgccgacgttcccgatccttactacacagggaattttgaagaagtctgccaattaatcaaatcgggctgtgagcatctgcttgcgtctattcaaaaagaaaaacaattgtgagtgaaaggagaatttgcatgaacaacgaacgtttaatgctgaaagggatatttctcggagctgcggcaggtgcggcgttatcactgctccataagccgacaagacaggcgtgcggcatgagatggctgacatgcaagcataaactttcactgtacaaaagcaatccggagctgttaaaaaacactgtcatcacaaaagtggatgaggccaaaaaactcgcccaaacgctttcaaaggaagtcgactttgtgaaccagcaggtgaaagagctgaagaaaacaacgccgcaagtgatggaactcgtgcaagaaacgaaagagcatttttcaaaaaaatgatcaaacatgcgaggtgagacgacatgagttttttgaaagagcttttcagcagatacacccttcatgaaggacaaagtaaatcagcggagctggcgtatttttttctattgtcactgtttccgtttttgatttttatgctgacgctcaccgcgtatcttccgctttctaccgatgatgttttaggagtcatagaacaatatgctcccgccagtgcgatgtcactcgttgaatccattacccatcaaaccttaaataatcgaaatggcggtttgctgtcattcgggattatcgccgcattatggtctgcgtctaatggaatgaacgcgatcgtccggtcgctgaaccacgcgtatgatgtggaagaaaaccgctcttttatcattgttcgtctaacctcgatttttttgacgattgccatggtatttacgattttagtggctttgcttctgccggtatttggccgggagattggaaggctcgcttctgactttgtcggcgcgtcggatctgtttttatccgtctgggccgccattcgctggggtgtcagcccgcttgtgcttttgattgttttttccgcgctgtatgtgattgcgccgaacaaaaagctgtctctccggtttgtcatgccgggtgcggtctttgcgactatcggctggatcattgtcagcacattgttttcattttacgtcagcacgtttgcgaactatagcgccacttacgggagcatcgggggaatcatcgttctgatgatttggttttacttgagcggcattttaattatcctaggcggagaaatcaacgctcttttacataaacgtaaaaagcttcctgatgaaaatccctaccattagcgcaccctataaacgaacttcggttcaaaaagaagtcggggggatatcgtgatgaccaagcatacgaaaaaaggcggaagccataacaaacaaaattcgaaaagcaaatcgagcaataaaacaagcggaagcgccaacggacaaaacggctaccattagcataaaagcctcctgacatgatgtcgggaggctttttgattaagaagatgaagaataggtttcagccggtgaccagcttttcggtttgcccagcacaagggccagccacacagcgctaagcgtgagagtaatgaagtagaacaagtttgcgctttcaaatgtctgcatataccagccgccggcaaccgggccgaggatgctgccgagactgaatgtaatgccgcaaagcaggttccccgccggcaggaggtgaggcggaagaaggtctgtcatatagctgatgccaagtgtaaaggttgatccgactgccattcctgcaataaaaaagcagccgccgatcacgtaaggcgaaggaaatacaccggcgatgaaaaagcaaagagccccagtcagcaaaatcaccagcagcacattccgcctgccgtatctatcgctgaggatgccgagcggaaactgaaagataatgcttccaatcgcaaatgcgggaaggatgatcgctactgcgtctactgatatccccaaacggagcgcgtacaccggaaggcttccgttcagcgccgtttccagaaagccgtagccaaatgtaggcataaaggcaacccacccaaacagcatggcctgataaaatcgcctgaaactattgtctgatttggtttcatgaggactggtttccgggtatgcattttgtagaaagaaaacaaaaagccacgcaaacagactgatgcagccggacacgataaaaggaagcgacggactcagcttgacaagcggcaccatgaatgggcctgcggcaaagccaaggccaaaggaaagcccgtaaatagacagatttctcccgcgattttgttttgatgacatggaggtcacccacgtttgcgtagaaaagtgaagcatgtggtcgccgattccaatgaacaggcgaagcaggaaccagacccaaactgactgaagccaaataaatccgaataagcttaaaatgacaatgcttccgcccatgacgatcagcggcttgaacccgagctttctgagcggcgcttccataaacggcgaagccaaaagcacaccgatatacagcccggtcgcgtgcaggccgttgatagcagcggattctccatttgtttcaaaaatgattgaaatgacaggcagcagcatgccttgtgaaaacccggaaatggatacgagcaagacaaggataaagaaatgaaatcgtgacatcgtgtcagttctccttatatggaatctatgttgatcgtacaatgttttccaaaagcaggcaacctgaaaaaagcctatatcacgctatacatttgccctcgtgtaatcatgaaggtttttgtgaagaataaaaataaaacaagtcataaaaaaggagctatttcaccatgaatcgtatcttttttattttagtggcggccggtgttccgctttctgtgattggcagtttgatgcattggccttccgcggttctatttgcagtttattgcgtgacgattatcgcgcttgcaagctatatggggagggcgacagaatcactgtccatcattgcaggaccgcgtatcggcggtttgttgaatgccaccttcgggaatgcggtggagctgattatttccctttttgcattaaaggaaggcctgacaggaatcgtgcttgcctctttaaccggttcagtgctggggaacctgttgctggtagcgggcctatcgttttttgtcggcggtttaaaatataagcggcaggaatttaatatccatgatgcccgccataactccgggcttctgatttttgccatcattgtcgcctttgtgattccggaggtattctctgttggtatgggaaacgccagcaagctcaatttaagcatcggcatcagcatcattatgattctgttgtatgtggcggcgctgtactttaaacttgtcacgcatcggggcgtttatcagccgaataatgccgctcagactgaagaagaggaagagccggaatggtcagggaaggttgcgacgattgtcttgtttgcggcaacgattgtggttgcatacatatccgaaaacctggtccatacctttcactcggttgctgaacagttcgggtggagcgagctgtttatcggggtcatcatcgtggcgattgtaggaaatgcggcggagcacgcgtcagcgattattatggccttcaaaaataaaatggacattgcggttgaaattgcagtcggctctacgctgcagatcgctatgtttgtcgcaccggttctcgtcatctgttctatcttttttccgacaagcatgccgcttgtatttacattgcctgagctcgtcgcgatggtatcagcggttctcttgatgatcgcgatttcgaatgacggggattccaactggtttgaaggggcgacactgcttgctgcatatgtcattatggcgatcggctttttccttctttaacctgaaaaaatgatggataacaacaaagcgggatgaaaagactaagggaaaatgccatagaaagagtgatatgatgaaaaagctatttcattccacacttatcgtgttgttattctttagttttttcggcgttcagcccatccacgcgaaaaagcagtttaaggttcctaattctgtcgcaagcatttcaaaggaaaacacgtatccgaatgcttcacaggatcagccaatgcttcagccgagcaagctggcaaaggaattgctcgatcattctgaggtgaagattgaaaatccgcatctcatcaaaatgctgaatgaatccaacatatccggcacaccgcttgcagtagggtatcgggcgacaatatttctcgggaaatgggcgctcggctatgaatcaaatgaaacagtcgcaaactgggaatataaaaaaatcaatacaaaccgtgcggataaccgcggcgggaaagaaacggctgaaatgcattatgcccaggaacagcagtacagagtgaagggcggcctgacagctaaagttccaaatgctgaagatgtcaaaagcatgatgatgcaaaaagcaatgaagaaaacgaaccttccgcttgcatttgagacggtcattggggctggcacaaaacgggatcagatttataaagtcgctcctaaaaaaatcggttatttacatgcatatgcaccggctgtgaatgaaaaaggaaaagtgacttacggagaagtgtacttagtgctgaaaggaaataaacgaaaactcgtcgtgaaaaatgtcacgtcacagggcatcggtgcgtggattccggttcaagatcatgtcacatttggctttcagctttcctcactgccaagataaataaaaaactgattccaactcggaatcagtttttttgtttattgggttctctcgattcggaccgcttcctcaagcatttgcacattgttttggtagagctggcgaacgagaacccgtctgactgcaaggctggcactgaaataatcatcatctttcaccatgcctttaaccgtaaattcgacgccgcgattgattttattcaatgcggtgatgccgtggatttgaaacggttctgtcggattgccgaattcatcccgcttcaatgaatcacgaagctcttcattcagcatgtcacatgcctcttccaacacgctgtacacgcggtccggatcttctttaaagctgataagaaaggattcggtaatccgcataaaatcaatattatagttctctatttgtctgacctcgccgttgctgatggtgagcagcttcccgctccattcccggatttgcagcgagcggaggccgatttcctccactgtcccgttgaacaagttgttgacggtgacataatcgcctttgtgcagctggcgttcatatattaagaatacaccagccagcacatctttgatcagcgattgggcgccaaaaccgatcacgatacctgctacgcccgccccggccaatatcttgccgaaatcatgcacaaataaagaaataacgtaaaagataaaaccaattgttgccgtatactgggtgacagaacggacaaggctttcaatcgttttttcctttttttcttcaataaaatccgtccgtttaaaaaatagctgtaccagccggttgatgataaagacaccgatccaaaggataacggcaacgaggagaatatcgacgattttattttgaaaaatctccgtaagtgtttctttcatccgcatctaactcctggcttgacgttttgtgaagtctgtatcctgataataactgtttttgacaagaacattcggtccgaggcaccggacattcgggcagtggcaacttagttccttcgcaagcttggtctctctccacttttcataggcggaagggaggctgtccgtctgaatgttgccaagcggcggggtatcaccgaaatcggtcacgataatgtttccgtcgaaaatgttcacattcaggcgggatcggccgtcagggtcatttcgcactgtgacgtttttcgccgcgcgaagccggcgaagcagcttttggtcgtcttcgtccggactgcaggcataaaacggcagcgttccgaacagcatccacgtattttcatcacgaatatccagcaagcggtgaatggcctgtctcatctctttcaggctgagggattcaagagcgcttgcgaaatcgcttggatacattgggtggacctcgtgacgctgacatttcatatcttctgtgatttggcggtgaatatgctcaatatgcggaagagttcgtttgttcagcatcgtttccgcagataccattactccggcatccacgagcgtgcggctgttttcgatcattttttcaaaatagcgcgcgcgctgttcgaaggtcggttttctgtccatcatggcaaagccgatttcagcaaaatcttcaactgtaccccagttatgagaaatatgtagcacatcgagatacggaatgatccattcgtaccgctcgatgtcgagggtcagatttgaattaatttgtgtccgcacaccccgttcatgggcatatttcaataaaggaacaacatattcttttactgatttcagcgaaagcatcggctctccgcctgtgatgctgatggatctgaggcgcgggatttcctccagccgttttaacagaagatctattggcagagcattcgggtctttaggctgcaatgtatagcctacagcacaatgctcgcatctcatattgcacagtgtcgtcgttgtgaattcaacgtttgtcagctgcatgtctccgtattggtcaacatccatataggcttcccaagggtcaaactcgggcgtaatcggacgcagcttcgtgttttgtgtcatgactatctaactcctttataaatgggcatactaacgctgccaacagttaattttagacctgatttgccaagatcgcaagtagcgcggcgattgaaaaacggcaaaaaatgagctaccataataaaaaatgaatggaggaacagaatggggaacgccgtaaacaataaagatcagcagattgattatttaaagaacagacttgacatgtttatgaacgtcatcgattcattagaccctgaagcaaccgacgttgaagatatagacaggcttatcagcatgcttgatgacctggaagccaaatacgaacgttttaaaaaagattgggaataaaaccgcgtgcccgccgcggtttttttattggcataaagcaacagtataaaacaaagcccctatctgtaaaataagaaaaaatgcagaaggagcgctggccatgaagtggatgtgttcaatatgctgcgccgccgtattgcttgccggaggtgcagcacaggcggaagcggtgccgaatgagccgattaattggggctttaaacgaagtgtcaatcatcagccgccagatgccgggaagcagctgaacagtttgattgaaaaatatgacgcgttttatttagggaatacaaaggaaaaaacgatttacttaacgtttgataacggatatgaaaatggctatacgccaaaagtgcttgatgtcttaaaaaaacatcgcgtaacaggaacgttttttgtcaccgggcatttcgtaaaggaccagcctcagctgatcaaacgaatgtcagatgagggccatattatcggcaaccattcctttcaccatccggatttaacgacaaaaacagctgatcagattcaggatgaacttgattcagtcaacgaagaggtttataaaattacgggaaagcaggacaacctgtatttgcgtccgccgcgcggcgtgttcagtgagtacgtactgaaagaaacgaaacgcctcggctatcaaaccgttttctggtcggtcgcttttgttgattggaaaatcaacaaccaaaagggaaagaaatatgcctacgatcatatgatcaagcaggcgcacccgggagccatttacctgcttcacaccgtatcgagggacaatgcagaagcgctggatgacgcgattacagatctgaaaaaacagggctacacatttaaaagcattgatgatctgatgtttgagaaagaaatgaggctgccgtctttgtaaaagagaaagacctctccttaaacggagaggcttttctttattttatacatttaatcagtgcggcccagtccagatccccgaagcctttctcaatcccgttttcaaaatggcttttggccagctcggcaagaggaagatttgcagaaacccgttttgcggcggcgagtgccaggttggtatccttcagccctaaagacattttgaagccggccggctcaaatttctgctcggccataatggttccgtaattttgatagactggagaaccaaagagcgcgctggcgatttctaaaaattgtttttgttctaagccgtatttctccatcattaagaaggattcagataacgcctccagcatagacacgagtaagaaattgatgctgattttcgctgcatttgctatcttgctttcttcgccgacgtcaaatacctgctggctgaggctgtcgagcagaggcttggcggtttgcttcgcttccgccggtcctgctgttatgatgcgaagcgcggctttggctgcggcatccggtctgccaaggacgggagcggcgagaaaggattgtcctttctctgcatgagccgctgcgagcttttctgagaactcaacactgattgtgctcatcgagatgtgaatgccgttctctgctaatccttcaagcagcccgtcttctccgaatgtcacggtgctgacagaatcatcatctgcaagcattgtgatgacaatatcagcggactttgccgccagccgcggcgtatcagctgcctgtgcgccttctgtgacaaggtcttctgtcttttgtttcgtccggttatagacagtcaattcgtagcctgcttgaagaacatttcgggcaatgggctgtcccatattgccgagtccgatgacagcaattttcaatctgatcactccctgaatattttttccattataaacaatatgaacagaatatgcatagcgatcggcttataacaaaaaagaacagcttcccgctgccctcatttaaaaatattgaaccatcctttatgtacaaaccaaatcagcatcccgattacaagcgcagccatcaggccaagtacagcaaaatatccgtatttccaatgcagctccggcatgaagtcgaaattcataccgtatacaccggcaataaaggtgagcgggatgaaaatggttgatacgatcgtcagtgtcatcataatcgcattcatccggtttgagtttagcgtcacgtagctgtcacgcaagtcagacgtcatgtcacggttggattccacaatttcagataactttaacaaatgatcatatatgtcgctgaaataggctttcgtttcccgctgttctttcacatggtcaaggcttaaaatccggtagagcaaatcacgcatcggaataatcgtccgtctcaaatgcaataggtctgttctgagatcaaacacctcgttcatcagcgttccatacgttttgtggggacggctttcttcaatttcattcagccggtcttcaattttatacacgagaggaaaatattcatcaacaagctgatccatgatcatataagaaatatgcccgggcccttttttcaatatatccggtgaagcatacaaacgctcccggactttagcgataccgggcgtttcgtgtaaatgaaaggtgacgacaaatttttcgccttgaaagatatcgacttcctccgtctcaagtgtttccttattcagcgcatgaatcacgtaaaaacgatagccgtcataatggtcaagcttcggccgctgcatatgctggaagcaatcctcaatggcaagcgggtgaaaatgaaaaaaatctctcaataacgccgtttccgtatcctccgggccgtaaaaatcaacccagtaccatgcaatatcaggctgttccactcgttcgatcggtatatttttcagcagctgatgctctgttgtgattgcggtaatgttgatcataaacaaccctccacctgccattatatcatgcggtctttatgagaaaagtatacggtactctctgcctaattcaagcggcatgttatactgaacaaaaacggaaaaaagggtggatctcatgtggaaggaaaaagtatctgtcacgcctccgtatcattttgaccgcgtgctggacaggctgtctttagaccccctcaatgctgttgatcgagaggcgagggaagtccgtgtgccaatcagaaatcaagcgggggacgtatgtattgtaaaggtacaggcgttaggccatgcgggcgagcctgagttcctcgtcagcggggaaacggatcagggagaaatgatgaaggaaatcaagcggatttttcaatgggaaaatcatttgcagcacgttctggatcatttttcaaaaacgagcctgtccgccatttttgaagagcatgccgggacgccgcttgttctggactacagcgtgtacaactgcatgatgaaatgcattatccaccagcagctcaatctttccttcgcttacacgctaacagaacggtttgttcatgcgtttggcgagcagaaggatggcgtgtggtgctatccaaagccggaaacgattgcaaaactcgattatcaggatctgcgtgatctgcaattcagcatgagaaaagcggaatacaccattgatacatcaaggatgatcgcagaaggcacactcagcttgtcagagctgccgcatatggcggatgaagacattatgaagaaactgatcaaaattaggggtatcggcccgtggaccgtgcaaaacgtcctcatgttcggacttggccgtcccaatttattcccgcttgccgatatcggcctccagaatgccatcaaacgccactttcagctggacgataagccggcaaaggatgtcatgctggcgatgagcaaggagtgggagccttatttaagctatgcgtctttgtatttgtggaggagtatagaataattcgtctgacaatgaaggaaatcctgcaaacgtgttatactagaaagatgtgaaaaaaccatttcactttctgccatccgcagaaagcttcatatagaaacggagagaacaacgtgaaccaacaaaagaaacaggcgcccgtcgaactgaaggtcggacaaacctttccgctgacgattaagcgtctcggcattaacggagaaggtgtcggctattttaagaaaaaagtcgtcttcgtgcccggcgcgcttcctggcgaagaagttgttgtgcaggccacaaaggtccagccgaagttttcggagggccgcattaagaaaatccgcaaggcatctgagcaccgggtggcaccgccttgccctgtttatgaacaatgcggcggatgtcagcttcagcaccttgcatacagccagcagcttcgggaaaaacgcgatatcgtcattcagtctcttgaacgccatacgaagtttaaagttgaaaacatggaaatcaaagaaacgattggcatggacaacccgtggaattaccgcaataaaagccaattccagatcgggcgctcgcaaagcggcagcatcatcgccggcttatacggccttgattctcatgacatcgtgccgattaaagactgtatcgttcagcatccggcaacgaacaaaacaacaggcatcgtccgccgcattttagaggacttcaatgtgtctgtttataatgaaagaaaacgaaaaggtgacgttcgcacgatcgtgacgagagtcggctttgaaacaggcgaagtgcaggtcgtgcttgtaaccgcaaaagaaacgcttccgcacaaggaagaaatcgtcaaagcgattcaaaagcgattgccagaggtcaaatccattattcagaatgtaaacggggcgaaaacttcagtgattttcggtgagaaaacaaaaccgctcgccggaaaaacagtgattcaagaagtgctcggcgacgtatcttttgaattgagcgcccgcgctttcttccagctcaatccggaacagaccgtcaagctgtatgatgaagtgaaaaaagcggcgcagctgaccggaaaagaaaaagtcgttgatgcgtattgcggcgtcggcactatcggcatgtgggtggcggacggagcgaaggaagtccgcggcatggacgtcatcaaggaatcaattgacgatgctaagaaaaacgccaaaaaacacggcatggcaaatgccacatacgtaacaggaacagccgagcactggctcccgaaatggacgaaagaaggcttccgcccggacgtcgtcattgtagacccgccaagaacgggctgtgacagcacgttcctggacacgatcaaaaaagtcaaaccgaaacgctttgtctacgtttcctgcaatccatccacgcttgcgaaggatttgcagacgctgtcgaaggactatcgcgtggactatatccagcctgtcgatatgtttccgcagacggcgcatgtggaagctgtggcgagacttgtattgaaatcgtctcattaattcctaatcagatctggatttcggcagaatgaacattgccgatttccgggtctttttcgtgcatagcccttgtcctaactgtctgttctcaattttatcttccttctcattctcggagatctttattttaactggcgaaaagagttgaaaaaacgtgttgaaaagcgggtgaaaataagcgttatttaaccgggaaaatatcctcccagtatgattaaaatacatgagtaaaataatgtaaaatcatagatatattttcataatttgtaaaattatatattgacttgcagttattatgtgtgaaatattgattataggaatataaggaaaggtatggcgtatatcatttcaagagtcattcgatgtaaaaagttgaaacattgtaattaaatgaaagaggtgaaaatgatggccaaccccattttaaaatgaataatgtatgagcactacaacaattaaataatagtgccgacgataacaactattacagtaatacctacaatggttatatccttgcgacaatcatgcttcataataatttagattgacacttggctaaaaagtattgcagagaaggaaatggataactaaatggataaagtatataaaaaacgaccgttatataaaagaagttggtttcaaacatttttggcatttttagtatctcagctttattttaattttgtagaattaacgggagggggtcctaagtatagagaaatgaatggattcccagcaaacatagttgaactagatttctttcaaacatatctttcattctatgataatccatggtttaatattattactgttttcttgggagttttcactattatacaaataattacaggggtaacaaaggatattcgaaattaaagcaataacttctgatgccttatttaataatgaaagaaaatgtacactttcttaattatcttatgagtgaagactgcgacacttagtcagcagtctattttattggttctggatcaggcttaccgaattataaccctatacaaatatatagtaggttgccacttgctgcgttggttattttctaaatcatgagcaaatgccaaatgattcagattgaagttcttgaattcttttaaataaggatttattttctcttctcatcctctttactccatgtgattcataagtggtagcagcttaagtagagttttttttattctcttgagtactcagttataccacccccaactcaatttgcttaatcaaagtttatctcttgaaattagtttttccgcaaatatgatattgagatacggatatggtgtagcgttaaatatcttatcctcaataacaggacaattagtttgcgttggtaatatggagaactcatatgatattctatttaggttggaatcctttttatccaaaaagttcaaaagcaaggccactaagaaagacgaaggtcagcgccagtgttaaccacaatataaaaaatagggtagctaatcatcccacgtgaaatgttcaaaatttactatagattgataagaaatgctttcgcatgcgataagtgtaaaagaagcatggtcagttttttaatattgagatacaggtatagccgtatcccctaatgaaaggatttgatttttgttatgacagaaaatttctggcgtgaattaccacggccgttttttgtactggcaccaatggaagatgtgacagatgttgttttccggcatgtagtaagtgaagcaggcagaccggatgtgttttttacagagttcacaaactcagagagctattgccacccggatgggaaggatagcgtgcgcggccgtttgacttttacagaggatgaacagccaattgtggcccatatatggggagataagcctgaaaacttccgtaaaatgagtattggcatggcagagttaggatttaaaggactagatatcaatatgggctgccctgtgcctaatgtggcacagaacggtaagggaagcggtcttatccgccggccggaagttgcagcagagttaatacaagcagcaaaagcagggggattgcccgtaagcgtaaaaacaagacttggtttcacggatgtagacgaatggcgcgagtggctgacacacatactgaaacaggatattgccaatctttctattcatctgcgcacaagagcagaaatgagcaaagtagatgcgcattgggaactcatcccggagattaagaaacttcgtgacgaggtggcaccagatacattgttaacaataaacggggatatccctgaccgccaaactggcttaaaacttgctgaacaatacggtgttgatggaattatgattgggcgcggtatttttacaaatccatttgcctttgaaaaggagccgaaagagcatagcagcaaggaattgcttgatctcttaaggctgcatctggatcttcatgataagtattcagcattagaagcgcgtccgtacaagcctcttcctcgctttttcaaaatttaccttcgcgggttccgaggggcaagtgaattaagaaatcaatgcatgaacacaaagtcaacagatgaagtgcgtgcattgctcgatgactttgagagaaagtatcttgatggtttagagtaacagcagtgcttgattcaaaaaaggctaacaccattcttgactaaaataaacctggatgttcggtaaaataaacaattccgatttccgggtcttttttgtacgcagcttttactcagcctgtcttttctctaatttattgtaagaaaataatggtatatttagtggagataacttataaagggggagaggaaaatgaaacgactatgcatcatcccctgcggcaagaaaaaaatctgggacgtccagcctgatgccgggccggtaagagcagaggacgcttatctcagcccgtttcatcaggtgtgcgagcggtatgcgaaagcatttttcgatgagtgggtgattttgtctgcgaagcacgggttcctccgccctaatgatctcgtttcgggaaattacgatgtcacttttggcaccggtcatccggaaatcatgacagcggacgagctgagccgccaatttcacgaaaaaggcttttctgatatcgaagagctagtcatgcttggcggaaaaaaatatcgaagcgttctaaacgccgtcatcggagagcaccagcatatcagctggccgctatcatcatacaaaggcataggctacatgctccaagcgctgaaccgagctgttgaagaaaagcatgaactgtagcacgtatataagaagaaaagagtgtgaacatgaaaaaacttgtgtttggcttgcttgccattgcgttattcggatgcggactatatatctatcatgtatggttcggtgatccattttcgaaaaatgctgcagaacagaagctagtctcttatgtgaaacaaacctatcctaagaaagaaatcaagatcacgaatggggtatataacgctaaaacctctgaatatgtattcgaagcaacctcccaatctcatcgctacccaatgtgtacgaagggatttctgcatcctaaagtaacgtgcgatggaattgaagaagcgtataccgaatcagtatcaaaacatgtaaatgaagaagcaacgaaggcaatcgaagcagatctgaaaaaagcggttcctcgacttataaaagctgatgctgctttgagtatcgaaaacggacagttcacgttagatacaaaatggaacaaacagctggctgaaaaagcgcctatgagcatgacgattcagttagacgccagcgggttatcaaaaacagatgccgcaaagatggcggaaattgtcagaaaaacgcttaatgaaaagggatatacatactcaaacggcacgatagactgtatgcagaaggacggggacggcggtatcggatatgtcaaatattcaattgattttctttcaaaagcagctattcagtcaaacgatgcagaggaactaggaagttaaaaagatttccaaggaaataaatacgtcgatcattgtcaaaggccgggtgatatccggtctttttttttgcatgctgtaaaacgagacaaatgaatcagtttgagacaaaacgagacacacgtctcaaactgtctccaaagtgaagacgagaagactgattttacgggctcaaaagactggcacacttcttgcatttataatggtgaaccctaaatagaaggaggcgcacaaaatgaaattgttaaaacgagaaggcttgtcattaactgaggaaaaagcgctgtggatgtaccaaaagatgctggagatcaggggctttgaagacaaagtgcatgaactgttcgcccagggagtgcttcccggattcgttcatttatatgccggtgaggaagccgtggctgtaggggtgtgcgctcatttacatgatggcgacagcattacaagcacccacaggggacatggacattgtatcgccaaaggctgtgacctggacggcatgatggcggaaattttcggaaaagcgaccggattgtgcaaaggcaagggcggttctatgcacattgcggatcttgataaaggcatgttaggcgcaaatggaatcgtcgggggcggctttacgctcgcatgcggatcagcgctcacggctaaatataaacagactaaaaatgtaagcgtttgctttttcggggacggggcaaataaccaaggcaccttccacgaagggctgaatttagcggctgtatggaaccttcctgtcgtgtttgttgctgaaaacaacggctatggcgaagccaccccatttgagtacgcatcagcctgtgattcaatcgccgatcgggcggctgcttataacatgccgggggttacagttgacggcaaagatattttagcagtttaccaggcagccgaggaagcgatagaaagagcaagaaacggcggcggcccgtctttgattgaatgtatgacctacagaaactacggccatttcgaaggagatgcccaaacctataaaacgaaggatgaaagagttgagcaccttgaagaaaaagatgccattcaaggttttaaaaactaccttttaaaagaaacagatgctaataagctgtcagacattgaacagcgtgtcagcgaatcgattgaaaaagccgtctcgttcagcgaagacagcccatatccaaaagattcggagctgctgacagatgtgtacgtgtcatatgaaaaaggaggaatgtaagagatggcgagagtcataagcatgtcagacgcgatcaatgaagcaatgaagcttgcgatgagaagagatgaaaatgtgcttttgatcggtgaggatgttgccggcggagcggctgttgatcatttgcaggatgatgaagcatggggcggtgtattaggagtcacaaaggggctcgtacaggaattcgggcgcacaagagtgctggacacaccgatttctgaagcgggctacatgggtgcggctatggctgcggcatcaaccgggctgagaccgattgcagaattaatgtttaatgactttatcggcacatgctttgaccaggtgatcaaccaaggggcgaaattccgctatatgttcggcggtaaagcgcaagtgccgattaccgtccgcaccacatacggagcgggatttcgggccgctgcccagcattcacaagcgctgtatggccttttcacgagcatcccgggactgaagacggttgttccatccagcccgtatgatgccaaaggtctgctgcttgcagcaatagaagacgatgatccggtgttcttctttgaagacaagacgtcctacaacatgaagggcgaggtgccggaagattattatacaattcccctcggaaaagcggatatcaaacgcgaaggcaatgatgttacgctctttgcagtcggcaagcaggtcaatactgcgcttgaagcggctgcacagctttcagagaggggcatcgaagctgaggtgcttgatccccgcagtctgtctcctctggatgaggatgcgattttcacatcgttagaaaaaacaaaccggctgatcatcattgatgaagccaatccgcgatgcagcattgccacggatattgctgcgattgtcgctgacaagggctttgatttgcttgatgcgccgattaaacggattacagcgccgcatacaccggttccgttttcaccagtgcttgaagatcaatatttgccgacaccagataaaattgtcagcgtcacgcttgaattgcttggcgagccggcaatgaattaaaggggggacacaaatggcggtaaaagtagtgatgccaaaattgggaatggccatgaaacaaggggaagtatcgatatggaataaaaaagtaggcgacccggttgaaaagggagaaagcattgccagcattcaatcggagaaaattgaaatggagatcgaagcgcctgaaaaaggaacgctgatcgatatcaaagtgaaagagggagaagaggttccgcccggcacagctatctgctatatcggggacgccaatgagtcggtgcaggaagaggcgagtgcgcctgttgctgaagacaatatgccgcaagccgttcagcccgtcaaacaagaaaacaaacccgcagcctccaaaaaagatcgaatgaaaatatctccagtcgccagaaaaatagcagaaaaagcaggattagacctaaaacaactgaaaggaactggaccaggcggacgaatcgtgaaggatgacgtaacaaaggctcttgctgaacagaaaaaagatcaggcaaagcctggttcggaacagaaagcgcaggaaatcccggtgacaggcatgagaaaggtcatcgctgcccgaatgcaggaaagcctggcaaacagcgcgcagctgacgatcacgatgaaggctgatatcactaagcttgccactcttcaaaaacagctttcatcaactgcggaagagagatacggcacaaaactgacgatcactcattttgtctcaagagccgccgttctcgctctgcaagctcaccctgtgctgaacagcttttatcaaaatgagcgcatcatcacacatccccatgtacaccttggtatggctgtagccttggaaaacggcttagtggtgcctgtcatccgccatgctgaaaagctatcgctgattgaactggctcaatcaatctcagaaaatgccaaaaaagcacgcgagggacgtgcgggaagcgaagaactgcaaggctctaccttctccattacaaaccttggcgcgtttggagttgagcatttcacaccgatactaaatccgccggaaacaggcattctcggcatcggagcaagctatgacacgccggtgtatcaaggggaggagatcgtcagaagcacgatcctgccgctcagcctgacatttgatcacagagcgtgtgacggcgccccagccgctgcattcctgaaggcgattaaaacatatttggaagaacccgcagcattaattttataggaaaagcaggtgaaaacgacatgacattagccattatcggcggcggacctgcaggctatgcggctgcggtctccgcggcacagcagggcagaaacgtgctgctcattgacaaaggcaagcttggggggacctgcctgaatgaaggctgcatcccgacaaagtctttgttagaaagcgcaaacgttcttgataaaatcaagcatgccgacagctttgggatcgaacttccggcaggtgcgatatcagtcgattggagtaaaatgcaaagccgaaaacaacaggttgtcagtcagcttgtccaaggcgtacagtacctaatgaagaaaaatcaaatacaggttgtaaagggaacagcctcctttctttctgaaagaaagctcttaatcgaaggagaaaacggaaaagaaatcagagaggcggaccaagtattgattgcctccggatcagagccaatcgagctgcctttcgctccgtttgacggcgaatggatcatcgacagcaaagacgcgctttctctttccgagattccgtcttcactagtcattgtcggcggcggtgtcatcgggtgtgagtatgcagggctgttcgccagattgggatcgaaggtgaccatcattgaaacagcggaccagctgattccggctgaagatgaagatattgcccgtctctttcaggagaaacttgaggaagacggtgtcgaagtgcatacttcatccagattagagcgggtggatcaaacggccaaaacggcaatatggaaaagcggtcagcgagagtttaaaacgaaggccgattatgtgctggtggcgatcggcagaaaaccccgtcttgacggattacagctggaacaggccggagttgatttttctccaaagggcattccggtgaatgggcacatgcagacgaacgtgcctcatatttacgcgtgcggagatgctatagggggcattcagctggcgcatgccgctttccatgagggcatcatcgctgcttctcatgcttccggaagggatgtcaaaatcaatgagaaacatgtgccgcgctgcatctatacgtccccagaaatcgcgtgtatcggaatgacagaacgacaggcaagaagcatatacggggatgtgaagatcggcgaattttcattttccgcaaacggcaaggcgctcattaaacagcaagcggaaggaaaggtcaaaatcatggctgaaccggaattcggcgaaatcgtgggtgtctcgatgattggcccggatgtaaccgagctcatcggccaagcggcagcgatcatgaatggtgagatgacggcagatatggcggagcattttatcgccgcccatccgactttatcggaaacattgcatgaggcgctgttaagcacgatcggccttgcggtacatgcataataaaggaaaaagcaggcgcatggatataaggcgccggcttttttattgttgaaagcgctttatttttcccctacaatagatgaaaacggcgtgtaagggaggagcgatcaaggaaatgaattcggtcccaaacgatttgcaaacctggaaacgttttgtgaaagacggtgtgcttgacgaagcccgattaagaaaacggattgcagagtcatggcatcgctgcaaaaaagctgaggtcaatccttatttagaaaaaggcccgaaggttttacagcaaacggagctggatcagcagtcaaaaaaacattcattcttcttgacgaccgcaaagccttacctcgaaaaactgctgcctgccataaaagaaatggaaatgatggcgctgctaattgatgcagacggtgttgttctggcattggacggccatcccctcgcgctctatgaagccaaacgcatcaactttgttgaaggggcatgctggacggaaacggctgtcggaacaaatgcgattggcacggcgctccacatcagcgagccggttgcgatacaaggatcagagcattactccattgcttcccatctttggaactgttcagccgctccgattcaccatgaggatggcagccttgcgggtgtgattgacatatcgtgtccggcggcaggcgctcatcctcatatgctcggtattgccactgcgatcgcctatgcagctgaacgggaacttgcagctaaaagccgtgagaaagagctcgagctgatcagccgttttggagagagggctgcatccagtgtgccgatggtgctatgcaataacaagcagcacatcatcagtgcgagcataccgattcgaacctcaatgcctgattggcagggccggcacctgtatgagttgaaggaacggggctactcaatcgaaaaagctgtcaccataggagatggcggcacttgtttttatctttcggaacaaaagaaaaagaaggtgttccgattcaatggagtgatcgggaaaagcggccgatcgcaagcgatgctgatgaaccttgaacgtgcagctgcggcagatgcaacggtctgtttgtcgggcgaaactggtacgggaaaggaagtcgcggctcgcgctcttcatgagaacagtgagagacgtcacggtccgtttgttgctgtcaattgcggagcgattccgtctgatttgattgagagcgaactgttcggctatgcagagggcgcttttacgggagcgaaacgaaatggctataaaggcgcctttcaaaaagcaaatcaaggcacattatttttagatgaaatcggagaaatttcccactcgatgcaggttgcacttttacgggtgcttcaggaacgcaagataacgccaatcggcgggacgaaagaaattccggttgatatcagagttattgccgccacacattgtgatttacgcgagcttgccgaaaacggaaaaatcagagaggacttgttttaccgtcttcatgtctatccaattgaactgcctccattacgcgatcgcaccgaggatatcccggacctctttgagtactacaaacagaagaatcattggccaggcgaacttccttctgatttttgtcatgtgctgaagcaatggaagtggccggggaatatccgtgagctgtttaatgtgtttgaacgtctttctatcagatttccggacggccggctgagggatgaaccgcttcccgctttactggaagccgctggattgccggccagctctgcagaaaaaaagccggctgctgccggcgtgcttacctttcgtgagcaaatccaaaaggatatgatgatcaaagcgcttgaatctgcaaaaggaaacgtctctcaagctgccaaaatcagcgggattccccgaagcactttctacaaacgcctgaaaaaattcaacttgtccgctgaatcgtaaagcatacttccttcaggaaatggaaacgttatgtattgaaggagggtgttacgatgaatattcaaagggcgaaagaaatagtagaatctcccgatatgaaaaaagtaacatataacggcgttcctatatacattcagcacgtgaatgaagaaaacggaacagcaagaatttatccgcttgacgaaccgcagcaggagcatgaagtgcagctgaacagcttaaaagaggattaaacaaaaatggcccgcttcataagcaggccattttgttatccgcgcggcgcaaataaaataacacagacaccgatgagacaaatgaatgcgccgatccagtcatacagatcaggtgttttccggtcaacaagccatccccacaggaccgcaagcacgataaatactccgccataagcggcgtatacacggccgaaagatgggaaggactgaaacgtcggaagaatgccgtatacaatgaggatcagcgccccggcgattccatagccggctggctttgcctctctcagccatagccaaaccagatatccgccgccaatttcggcaagccctgccgcgagaaataaaagaatggtaatcagcatcatgagcactcctcaatttgcatttatctttcattatagaggaggagagcttttaaagcttcggatgattctcaaattccttcaaatacgcttttcgctgaacctctgtaaattggctgatccaattgttttgagcctcttcattcaaatggggaaggacatagcgttcaaccgcttcgaaaaacagcggattcgcgatgatgttccaggtcgggatgcgaacgattttcccgtctgttttctcgatgataatatcctcaaaaaagatccctttcagactgtattggtgacgtcccatataaagccgcttcacctcggaaaacagcacgctgcgctttctcgagaagatctcgccactaggtccggtctttatgctgaaaatgacatttccacggcttgtgaacgcaggaaaagccataaagaatgtgatcaatccataaattatcgccagtaatccgccgcccaaataaagcagggcatatttagattcaaacgtgagagcttcagccaccagccagactcccacaataaaggcgccccctgtagcgaggaacagccatattctaaaaaacagtctgcttttgaccttaatgacttcattgtttttcaattgctattctcctttatcgctctttagcaaaaagtattccttttatcacatctttatttgctgttacgatagaaaattcattttgggtaatacctgttaccagccaagtatgacggctgccaggcaggacgaaagccatgtcagctacttctggggagttgtctttgtcataaaccagccgcatcagcgtatccatttttccttttcgcaaagccagatcatttacaaaacgggtaacgtcctcttggtgatcatgcttatctagaaactccttgagatgtgtgggagtgtctgaagcgccctccaaaagcaattcaaattcagttgatgtcagagagagcattgattctttgtgatcttctgcatctattatatttaaaaactcggatgttttagagagtaatccattagttgaatccatttttttgattctatgcacctgttcatcaaacagcaattcatgagagtaagtgccaaactttgaaacatggcaggatatattctgttctttgccttgttcatcaaatttggacagcttcactgtatagtccgcgtcgtttaacacatggataaacggacagtattcgtcctttagccgatattgatgattccgatattccgcagcgtccttggctaagagtgagcggcacgcggcttcaaataaggcgccgagctgttcatcttctatttcgggaaaataggcttgttttaaggccattccctgttcgaaaaacccttcgctgtaaaaacaaaacaagagttcttctatgctgattgtaaactgcttcattgtttattctcctatccaaatgaaaatttccctttaaggaaatgggttgcgccgtgtatgagcgaatccgctgttttctttgctttttctattccttttttcgcactgtctatccctttatgtatcgttttattcgccgcatctatgccgtcattcactgatttgacgactttgccggctgattccagtccttttttggctgtatcaacgacagcatggatcggttctttaagttttatcgctgctttttcagcatagactgatgtgaattttgcgattttttccccaacaaaccctcctactgccgaaccaattgtgcctccgattactgtgcctacaggacctaacacacttcctacggcaccgcccacaacagcaccagctgtcgcaccgcccgcaataaaaatggtgttattcacagcatttccgacagccttggcgttttcacgcttgagaacttcgggtttattctggtattttgcataattttcagcaattttcacgcctgctccgaatgtttcggtcgcaccggtaatcagtgtggcggtaatggcatttcctttcgcgaatctcaagcccgtttttcccacatccttcaaagtggagcgtacgccggcttcattaagaaatccttttgtgtagcttctgacgctgtttgaaaaatccaccgtgtcctgagggaagtattttgtaaactttttatgtaccaaatctgaaaatggacggttggtcttttttaacaaatatttaggattcaaaagcactcttgccgctttttgataacgtgagctgtcaacggccctggaaatatccaagagcagttttgagtgctgggctgtatgcaagccgcttggctgtttcacaaatttcgtaagccctaatccgtaatattttccctgcgtcagcataagagcggttaagcttgtcatcgtaccgtatttgtcgtaggcattgtagagctttcgcaaaatatcatcttgttccacaaatttatcgcctgtttttctgatgaaaatctcattgtcactcagcttagtgacgagcgcctttcctgagctccacgcatcgcccactccagaaaaacagctgctgtagcggggatcgcattgcaaaatcatctgccccagctccacatgcaggtccttatatttgttttccatatcagttaattcagtgactacatcatttgcaagctgttcgagcttatccggatcaactgcaatgtttcctgacacaccgttcacctcccgagtttatgtctttcctctcttgctttacgctccagttcttccattctggcaatttcagcttttcgttcttctattttgacagcggcagccttcagctcttggcttgtttcaagcagctcctgttcgaattgatcgtaggcggctttcgtttcctcgaaatcctggtcaaacgaatctcttgatttgccctgccaagcatctcccaatgcagataaccgggattcaagcaacattttggagcttctgacctcttctgcggccgcactgtacttgtttgccagctcaatgactttatatgagtccaacttttgtcccctgccttttctaaattcacgcacaattggatgttttatataaatgattataaataattcggcatgtatccgaatcgtacaaaagaaccttttcataagaattggaagggcgtatattcacttaaaattcacagttggtgagactttaagattacaaaaaaggtaaaaaaaacaaatccctcagacataaggcaaatgagaaatttcccgctctatgggaaaaaacactaaagttgatcaaatgacctaagtgcgccaaacgtgttacgggacgggctatctcatggtataaatggaattgtaaacgttatcaaggaggtcgtcatatgaagaaaaaatcattctcaatcgtaatagcgggcggagggagcactttcactccagggatcgtactcatgctcttggaccatttggaggagtttccgatcagaaagctgaagctgtatgataatgataaggagagacaggatcgaattgcaggcgcctgtgacgtttttatcagagaaaaagcgccggatattgaatttgcagcgacgactgacccggaagaagcttttacagatgtcgattttgttatggcgcacatcagagtagggaaatacgcgatgcgtgcgcttgatgagcaaattccgttaaagtacggagttgtcggccaggagacgtgcgggccgggcgggatcgcatacggtatgcgttcgatcggcggtgtgcttgaaatattagattacatggaaaaatactcgcctgatgcgtggatgctcaattattccaatccggcggcaattgtggctgaagctacgagacgccttagaccgaattctaaaattctcaatatctgtgatatgccggttgggatcgaagaccggatggcgcaaattcttggcttatcctcaagaaaagaaatgaaggtccgctattacggattaaatcacttcggctggtggacatcaattcaggatcaagagggcaacgatttaatgccgaagctgaaggagcatgtatctcaatacggctatattccgaaaacagaggctgaagcggtggaggcgagctggaatgacacattcgccaaagcgcgtgacgtgcaggccgcagatcctgatacactgccgaatacgtatttgcaatattatttgttcccggatgatatggtgaaaaaatcaaatccgaatcatacgcgggcaaatgaagtgatggaagggcgcgaagcttttattttcagccaatgtgacatgattacacgtgagcagtccacagaaaacagcgaaatcaaaatcgatgaccacgcatcatatatcgttgatcttgcccgggcgattgcctacaacacaggtgaaagaatgctgttgatcgttgaaaataacggcgcaattgcgaactttgacccgactgcgatggtcgaggttccatgcattgtcggctcaaatgggcctgaaccgattaccgtcggcaccattccgcaattccaaaaagggcttatggagcagcaggtatccgttgagaagctaactgttgaagcgtgggcggagaaatcgttccaaaagctgtggcaggcgctaattttgtcaaaaacagtgccgaacgcgcgtgtggcaagactcattctcgaggatttaatggaggccaacaaagacttctggcctgagcttgatcaaagcccgacccgtatatcataactgaaattcccccattttcgaatctgtaattgtatataatagaaagaaaatggggggatctgatatgcagctcgaagaactgatcaatcagcactacagcaaattgaatgacaacgattttcatattttaaaatatatattgaatcataagcacacatgctatcaccttggaatcgacgcgctggccaaagcttgcagtgtatcgcgttcctcaattttacggcttgcccaaaagctcggtttcagtggctacagtgaatttcgcgtctttttaaagtgggaagatcagccggaagaaggcgagagtatgagttttgaaaagctgcttgatgatattgaagcaaatttgaagttcttacggacaaaggacatgacggacatgtgccagctgattgatgaagctgaccgcattttcgtctacggttctggaaatgcgcaaaagatatgcgcccgcgacctgcaaagaatgtttattccgcgccatcgctatcttattttaattgaagacacaaatgaatttaatttgatgcgcgatgattttaaagtaaacgatctgtttatcatcatttctctttccggagaaacaccggagctgattcctcaggcaagaatgctttctgcaaagggtattccctttatttccattacgaatttaaaaaacaatgtcctcgcccagctgactccgcataatctttatgcgacaagcaaacctgtgacattaagcgataaaacggaaattgtcgcttttgcaccgttttttctcgttggcgaagcattgttccgcgcatatgttgattacaaagaggcagaaaaaaatgacaatgagtagcagggggttctggtatgatgcaaaaaattcagcgctttggaagcgcgatgtttgtgcctgttttattattcgcgttcgccggcattatcgtcggtatcagcacgctctttaaaaataaaaccctcatgggcccgctcgccgatcccgacggtttttggtatcagtgctggtatattattgagcagggcggctggactgtttttaaccaaatgccgctcttattcgccatcggcatcccggttgctttggcgaagaaagctcaggcacgcgcttgtttggaagcgcttactgtttacctgacattcaactattttgtcagcgcaatattgacggtatggggaggagcatttggcgtcgacatgaatcaagaggtcggcggaacgagcggattaacgatgattgcgggcataaaaacgctcgataccaacattattggagccatctttatttcttcgattgtcgtctttttgcataaccgctattttgataaaaaactgcccgattttctcggcatctttcaaggctcaacatatatcgtgatgatttccttctttattatgattccgattgccttggctgtgtcttatatttggccgatggttcaatcgggaatcggctcgcttcaaagctttctggttgcttctggggcggtgggcgtttggatatacacgtttttagaacggattttaattccgaccggccttcatcactttatttacacgccgtttatttatggcccggctgtagcggaaggcgggatcgtcacgtattgggcacagcatctcggcgaatattcgcaaagcgccaaaccgctgaaggagctctttccgcaaggcggattcgcgcttcacggcaactcgaaaatcttcggtattccgggtatcgccctggctttttatgtgacagccaaaaaggaaaagaaaaaactcgtcgcagggctgctgattcctgtcacactgacagcgattgtcgccggtattacagagccgattgagtttacgttcttattcatttcacctttcttatttgcggttcacgccgtgcttgccgccacaatgtcgacagttatgtatatggccggcgtcgtcggaaatatgggaggcggactgattgaggcggtaaccttgaactggattccgctctttggcagccacggtatgacatatgtgtatcaaattttgatcgggctctcgtttacagcaatttattttttcgtcttcagatttttaatcctcaaattcaatatcgctacaccaggacgggaaaaggatgaacagcaggaaacaaagctatattcgaaaaaggaatacagagaacgaaaaaacaaggatgaaacggcctccgctgctgaaacggctgatgacaccgcttttctgtatattgaagcgctgggcggaaaagacaacatcactgaagtcacaaactgcgccacccgcctcagagtcagtgtcaaggacgaaacaaaggttgaacccgacagcgtattccgcgcgcttggcgcacacggcgttgtcaggaacgggaaggcgtttcaggtaattatcggattaagcgtaccgcagatgcgggagcgtgtggaaaaaatattgaatcaataaagactgccctccttttcgggagggttttcgtttgccgtcaaaaagaccgccatagtaaagtaaagaaagagacaatcgagtaaaaaggggtttggaggcttttacatgcaaaaggctttgtcgtttttaaaaccatattcattgctggcgggaattgcgctgattcttatgttgacggagcttgcagttgaactgctgcagcctttattgattgcgaaaatcatcgacgatgggatattgaagcaagatctgcggcatgtttggatatggggcgcggtcatgatcgggctgaccgtgttatcctttgcggcggggatgctgaattccttttatgccgcccatgtcagccaaagcttttcctatgatacgagaaaagggctttttcaaaaaatccagtccttctcctattccacatttggacagttttcgtcctcttcttatattacaagactgacaaacgacgtcacacaggttcaaaatatgatttttatgagtttgcggtttatgctgcgggcacccttaatgattgcaggcggcattgtgctgtcgcttgccgttaatgtgaaactcggcttttttctgcttgtgaccattccgatcctgatcttgtttttgctatgggtattaaggaaaggcggggcactgttccgctcagtgcagaaaaggctggatcaagtgaacaccatcatgcaggaaaatttaattgcaatcaagctgatcaaagcgctgcttcgcggcagccacgaagtcaaacgatttatcaaagccaacacaaggctgatggaaaaaacggtttcggcctttcagcttgtggaattcacgatgcctgtactgatgcttttgatgaatctctgcatccttttgattttgtgggcggggtcctacagtattacgagcggaagcactcaggttggcgatgttgttgcgataattaactacgcaacacgaattacaggcgcgctttcgatgtttccgtttttgattatgattttcacccgggcgaaggcttcaggggatagaatcggtgaggtgcttgaaacagaaggcgacgagcgggaggaaggcaccatatctgatcgtttgtcaggacggattgagtttcagcatgtatcctttcgctatcctgaaatggacagagaagcgctcaggaatgtctcattttccgcaaagccaagagaaacgatcgcgattctcggtgcgacgggctcgggcaagtccacgctttttcagctcattccgcggctttatcagccggattcaggccgcatttacatagatgaaaagccggttcaagatattccggctgaagggctgcgcaggcaaattggatatgtaccgcaggaagtcctcttgttttccggcacaatcaaagaaaacatcgcttggggcaaagaaaatgcttcactagatgaaataatggatgcggccaaacatgcgcaaattcatgaaacgattttgaagctcccaaatggatatgacacagttttggggcaaagaggcgtcaacctgtccggcggccagaaacagcgaatttccattgcgcgggcgctgattcgaaaaccggctatccttctattagatgacagcacaagcgcacttgatctgcaaacggaggcgaagctgcttgaagcaatcagcacataccattgcacaactttgatcattacacaaaaaataaccacggcgatgaaagctgatcagattttgctgctagaggacggcgaactgattgaaaaaggcactcacagtgagctgctttctgaatctcagttatacaagcgcatttacgagtcacaattcggaagggaggggagcgagtcatgctaaaagacatccgcaagcctttccaatatcccaaactgccaattgacaaaaaagaaggcgcgaaaaagcgggccaaagcaaaggatacaaagggcacactgagacgaatctggtcttacttggctgaaagaaaaggactgctcatacttgtcatgctaatggttgtcatcagcgccatattcggactccttggtccctttgtgatcggaaaggccatcgaccattttatcgtcgggaaaacggtcagcggcttgattcctgttttgcttcttctgcttgctatctatatcattcagtccctgtcgctttggtttcaaaactattggatgattacgatctcgcagggcacggttttcagaatgagaagcgaattgttcacccatctgcatgagctgccgattccattttttgataaacagcggcacggcgagctgatgagccgggtgacgaatgacatcgaaaatgtcagttctaccttaaatacgtcagtcattcaaattttgtcaagcgtgatcacctttgtcgggaccattgcagtgatgctgtacatgagcccgctccttacattgattacgctgaccattattccggtgatggcagcgagcctgaaatggatcaccaaccgaacgggaaagctgtttaaagaacagcagaaaaaccttggtgatctgaatgggtatattgaggaatctgtttcaggcgcaaaggtcatcaaagcatattcacgtgagaagcagattactgctgaatttctcgaaaaaaacgctgcactcaagacgtcgggcttttgggcgcagacgatttccgggtttatcccgaaggtcatgaactctttgaataacttaagctttacaatgatagcggcaatcggcggtttgtttgcgctgaaaggctggatctcgatcggctccatcgtcgtctttgccgagtattcaagacaatttacacgccctttaaacgatctggccaaccagtttaatacgatgctgtccgcaatcgccggcgctgaacgggtgtttgacgtgcttgatgaaaaagaagagcgcgaggatgaaaagaacgccgtgcatcagcccatccaaacaggcagcattgaattccgggatgtgtccttcggttacgataaagggcagcagacactgaagcatttacagtttaccgtgcctgccgggcagtccatcgcgtttgtcgggcctacgggggcgggaaagacaaccgtcactaaccttctcgcccgtttttacgagcctgacaaaggaaaaattttaatcgacggtacagatattaaaacccttactagagcaagcctgagaaaaaacatggggtttgttcttcaggattctttcttatttcagggaacgatcagagaaaacattcgctacggcaggcttgatgcttctgatcaggaagtcgaagccgctgcaaaaacagcgaatgcccatagttttattgaaaggctgccaaaagggtatgacaccgtgctgacgcaaaacggttcgggcatcagtcaaggacagaagcagttgatttctatagcgagggcggtgcttgctgatccggttcttctcattttggatgaagcgacaagcaacattgataccgttacagaagtcaacattcaagaagcgctcgcccgtttaatggaaggaagaacaagcgtcatcattgcccacaggctgaacaccattcaaagagcggaccagattgtggtgctaaaagacggtgaaatgattgaaaaaggcagccatgacgagctgattcggcaaaaaggattttacagtgacttatatgaaagccaatttgagaaatagacctttgtcctgcacagaggtcttttttgttacagttttatagtacttttatttcattttcgtaaaatgtaacaaaattacttgacgtaaacaagttatgtatatatactagcttacattaagtaagtgataacatttatcaaggaggataaaatgaataaatcatttgaaattggcacattacttttaagagttattacaggtattatcttttttgttcacggtttatcaaagtttcagggaatggagggcaccatccaatttttcggcagcataggccttccaagctttatggcgtatgtcatcgcagcgattgaactcattggcggagtgcttgtcttcttcggattggctacacgtattgtcggtgtactgttcgctcttacactgatcggcgccatcatcactgttaagctgaaagcgccattcatgggcaatgcagaatttgattaccttctgcttttgacatccattcacctggcgcttactggaagtcgattcctggcgctggacccatttgtgtttaaaggaaaaaagaacgaaaacgtttcagcataagaaaagaggcatgcagcatgaccagcattcatgaggatacacacattggctatgccaaactcacaattcgcagtctggagcgttcgcttcagttctactgtaacgtcatcggttttcaagtcttaaaaaagacggatcgccaagcggaattaacggctgacgggaaacgcgtactgcttattcttgaagaaaatccgagcgctgtcgtcttgcctgaacggtctgtgacaggcctttatcactttgcgattcttcttccggacaggaaagaacttgggatcgcgctcgcccgcctgattgaacacggcattgctatcggacatggagaccatgctgtcagcgaagcactctacctgtctgatcctgacggaaacggcattgaaatgtacgctgaccgcccccgcagcacgtggcagcgtgatcgggaaggaaactatgtcatgacgacaaccgctgttgacattgagggccttctggaagaggcaggagatgagcggaaaacatcgcttccgaacgatacaatcatcggacacattcatctgcatgtcagtgatttgaaagaagcaaaggcgttttatacagatgtactgggctttgacattgtcggaaactatgcgggcatgtccgccctcttcgtttcagccggggggtaccaccatcatatcggcttaaacatttgggcgggaagaaatgcgccgcctaaaccgacaaatgccagcggactagattattatactgttgtcctgccccaccaagaggagctggatttggtggcaaaccgagtcaaacacgccgggtattcgattgaagagacggaaaacagctttcgtgtgaaagaccctgtttccggcgcctatattacatttgtgatttaactgcaatccccttgccgaaaaaacggcagggggattttttattttccagaaactcctgtcaaaaatgccctgaggcaggtatgataagaagggaattgggtatcgggagtgatgagcgtgaaagctcttttttttacgagaatgttcaccttgatggtgagctgtttaatgtatctgtccattgtgaaagaggataactggtttggatatgtatttatagcagcaggtgctgccatgtatgcagccaatcatgttttgctgacaaaagagacaaatgccatctggttctgcctgattgatattgcaatcggcttttctttcggatttatctttcccggcacaggtttgttcattattatgctttgtccggttgcggtcgccttttttctgcggaggtttcctaaaagaacagcatggtctgtcttatgtctttcctctattttatttttgaccgtcctcatccgtacatatgcgatgttcggcaatgaatttgtcattgatcatttgactagcatgacattcgttgtcttctgcggtgtcgtgggcaaattaatccgcaagctgttggatgcgcaggatacggcaaaacagcagtttcaggaactgacggagtcccatctggcgctgtctgctgcacatcaggagctccatttatatgcgaagcaggttgaagagctgactgccatttacgagcggaacagaatggcgcgggaaatccatgatacagtggggcataaaatgacggcccttctcgtccagctgcagcttttgcgtgaatggcaaaaaagagacagccaaaaagcggatgagacagtaggtgtctgtgaaacacttgcccgtgaagcgcttgatgatgtccgcttatcagtacgcaccctgcaaactgaaaacgatccttcgctaatcgaatcgctgaaacagctgacagaggacttttgcaaaaatgcaggagtcacaacagaatttgcggtcagcggtgatcctgcaatcatcccgctgtctctccatccgaccctgatcagaacggcgcaggaagcactgaccaatgccaaacggcacggcggcgccgcagcttgttcgatacagcttgcctgcacaacggacagcatcagccttgtcattaaggatgacggcaaaggcaatcccgaggcagcacttggttttggtctcttgaatatgaaaaagcgggcagcggaacatggcggaatgatccgctttgaaagcgaacaggatcaaggatttactgtgaatgcagaattttcacttgccaataaaaaatggagcttcaggcccgtgcagcaaaaggagagtttattatgattaagatcatcattaccgacgatcaggatatcgtcagagaagggctggcatccctgctccagctcagagaagagctcgatgtgatcgcaacagcgcgaaacggacaggaagccttcgaaaaggcgaaagagctggagccggatatcgtattaatggacatccgcatgccggtttccaacggggtggagggaacaaaattaatcacaagctcattgcccggcgtaaaggttttgatgctgacaacctttaaggattcagcgctgattgctgaagcgcttgaagaaggagcaagcgggtacctgctgaaggatatgtcggcagatacgattgtaaaagcggtgatgactgttcattctggcggaatggtgcttccgccggaattgactgcccaaatgctgaatgaatggaagcgtgaaaaacagctgaaaggaataaaagagatagaaaaacctaacgagctgctcgacctgaccgagcgcgaaatcgaagttctggctgagctggggtacgggctcaataacaaagaaattgccgaaaagctttacattacagaaggcacagtcaaaaaccacgtttcaaatattatcagcaagctggctgtcagggacagaacccaagccgccatttactcggtcagatatggtatatctgtcttttgacatatgacgttttgcatatatgcttctctgaaaaggccttttacaggcctttttttcatgccctatgttctatctgccgctacatgccgcacgcctttctttcttctacaatggcaatggatcaaaaaaaggagtgagacgacgtgctgcaagcagaaaacatcaaaaaggcatatggaaaaaaaacaatcgtgaaaggtatttctttttccctccaaaagggggagtcgttcggtctgctcgggccaaacggtgcggggaagtccacaaccatttcgatgatttccggccttgtgccgcatgacagcgggaacatcacggtgggcggctatgtcatcggaaaagaaacggccaaagcgaaacaaaaaatcggcattgttccgcaggaaattgcattatatccgacgctgacggctcatgagaatcttatgttttgggggaaaatgtacggacttacgcacggcgaggccaaaaaaagatcggctgaggtccttgaatatgtcggtctgactgagcgggctaaagataagattgaaacgttctccggggggatgaaacgaagaatcaacatcggtgcggctttaatgcataagcccgagctgctgattatggatgaaccgactgtcggtattgaccctcaatcgagaaatcacattttagaaacggtcaaacagctcaacgaaacgggcatgacggtgatctatacgagtcattacatggaagaggttgagtttttatgcgatcggatcggaattattgatcagggggaaatgattgcgattggcacaaaaactgatttgtgcagccgccttggaggcgataccatcattcagctcacagtcagcgggatcgatgaagcgtttcttttggcgatccgttccctggctcatgtgaatgatgtaacagtccaggagtcagagctcaaaatcgacatttctgcggctcatcatgagaaagtcgtcaccagtctgcttgctgaagccgctgctcatcatataaacctgctgtctcttcaggtgcaggaaccgaatctggagcgcctgtttttgaatctgaccggccgcacgttgcgggattaggaggggcggcaatgaaaaaaagcatatggatcgcatggaaagatgtcaaaatcagaatcacggacagaaaagggtttatgatgcttatcctaatgccgctgatcctaacgtgtattttaggggcggcgctcggatcagttgttgacggaggcaaccggattgatgacatcaaagtcggctacattcaatcagaccagtcagatgcagcgaacatgtttacaaaagatgttctcaaaaaaatgaagtcgataaaggccacaaaagccggcagcgaagacaagatgaagaagctgattgatgaaaagaaaatcgatgtaggcatcgtcatcccgaaccattgggaagccggcaaaacctcagctgttgtttatgccgcacctgatcaaacattgaaaagttccatcatcgaaacagctgccagctcttttatagagcaatataaagcggtaaaggaagccgcgtcagcctcaatggactacatcagcaaaacggaagctgtacagcaaggaaaacttgaccctgcacagtttgcagaaaagctggcaaagacgctagaaaaagaaacaggtgacaagctgactattgcagaaaaatctgtcggcagcaaggccgttaccagctttcaatactattcggcggcaatgctttgcatgtttatgctgtttcatatgacagtcggggcgaaatcgtttttacaggaaaaggatacggagacgcttgccagaatgctgatgacgcctgcgcaaaaatccgtcattctcttcggaaaatggcttgggacgtatctgtttgctatcatacaatttttcatatttctgatcgtcacaatcaatgtatttggtgtggactggggcggtaatctgctgtttgtgagtgtactcgggctttcttacgccgcagctgtatctggtatttcaatgctgcttgcgtcgtgcatcagcgatatgaaatctgcagactcgataggcggcttcggcattcaattgcttgcggttctcggcgggtccatgctgccgctgtaccaatttccggacgtcttgcagtctgtatccaaagcggtgccaaatcgctgggcgcttgacggctttctttctttaatggaagggggaggctgggctgaccttcaaaagcctgtgcttctttttgcggcgatcggcttttgttcacttgtaattggtatcagacggcttcatacaagataaggaggtacaaaaggtgaaaaaaattctagccatttgcggcattgagctttctctcatttttaagaagccacagaactatttgatcatgtttgctgccccgcttttgcttacctttgtatttgggagtatgctcggcggcaatgatgataaggtgcggcttgcaatcgttgatcaggacgatacgattctctcacagcattatattcggcagctgaaggcacacgatgatatgtatacattcgaaaacgtgtctgaaaacaaagcgtcagaaaagctgaaacaaaagaaaattgccgggatcatcgttatttcccgctcgttccagacacagctggaaaaaggcaaaaaccctgaactgattttccgtcacggccctgaactgtcggaagcgtcgatggtcaaacaatatgcagaaagcacattggcaacgctcaatattcaggtgaccgcggcaaaaacggcatctcagacagcgggagagaactggaaggcggcgtataaaaccgttttcgccaaaaaacatgaagatacagttccggctgtaaaacggcagacgctcagtgataaaaaagagggcgcggaagcaagtgacacagcctccagagcagcaggtttttccatcctgtttgtcatgctgaccatgatgggagcggctggaaccattttagaagcaagaaaaaacggcgtctggtccagattgcttacagcctctgtcagccgagtggaaatcggtgctgggtatgtgctgtccttctttgtcattggctggattcaatttggcatattgcttctttccacccattggctgtttgccatcaactgggggaatccggctgcagttattgtattagtgtcactttttctattgaccgttgtcggcattggattgatgattgcggccaacgtcagaacgccagaacagcagcttgcgttcggcaacttgtttgtcatcgcaacatgtatggtgagcgggatgtattggccgatcgacattgaaccgaaatttatgcaatccatcgctgaatttcttccgcaaaagtgggcgatgagcgggctgacggagattatcgctaacggtgcccgcgtcacagatattctcggaatctgcggcattttgcttgcatttgctgcgatcactttcgcagcggggctgaaagcgctccgagcctaaaaaacatctgccgtttaggcagatgttttttagcatgtgggtacattcgtatgggtgtagcctgaactgcggttaatccttatctatcatagctaaaattgattccagccaagaaacgtaatttttctcccgctccagcgctttcgttagcacaagatagtggccgaagtccggtgaagaaaatgacatcggctctgctgaagccataagcttttcatagcttccctgtaagtcagaaagcttggcctgtcgtttttgcagctggtctttgaacaaatcagaagcctcctggcgcgatagacaagaaatgaaataagccttcagcataaattcatccttcaccgtctcgggtatcggctggtggcggatcagccagtcatgcagttcctgctttccgctgtctgtcagggtgtacatctttttctccagctttgtgccctgaatcgttgtccgaaacgtgataaatccttcatccgtcagctttttgagctcagggtaaatctggctgtgcttggcgctccaaaactggccgagctcctctttaaaataactcgtaatatcgtatccactcaattcgccttttcgcaaaagccctaatatggcgtattttaatactctcatgctatcctccgtgtctggctgtttcgcaaaacagatgagccggtgctcaactgtgattctaactgcctattccccttattatagaaaagggaggaagggaacacaaccgggctctttggaaatgaagataaaaggtttgtcagaaggtatccgatttatctccgtcaatataaaagagatttaaatttaattttcagaaaaaatagtaaccatattgattttttatgtataataggaaattggtggtatgaacatgttaagggggaataaacgtgaaaaaagtacttatggcattcattatttgtttatcgctgattctatctgttttagccgctccgccgtctggcgcaaaagctgaatcagtacataatcctgtcgttcttgttcatggaataagtggtgcatcatacaactttttcgctattaaaaactacttaatttctcaaggctggcaaagcaacaaactatacgcaattgatttttatgataaaacaggaaataacctaaataacggcccgcagcttgcttcatatgttgaccgtgttttaaaagagacgggggcaaaaaaagtagatattgtggctcatagtatgggaggcgccaatacgctgtactatattaaatatttaggcgggggcaataagattcaaaatgtcgtaacgcttggaggggctaatggtttagtatcatcaaccgcgctgccgggtacagatcctgatcaaaagatcctctatacatctatttacagtctcaatgatcaaattgtcatcaatagcttgtctcggttacaaggagcgcgaaacatccagctttatggcatcggtcatattggcttgctctctaatagccaagtgaacggctatatcaaagaagggctgaatggcggaggcctcaatacaaattaatatcttcaaaaaacaacctgctgtctccgttacagtgggttttttcgtctgagaaagccatagggtcttatgaccttagtctatcatgcatacgtcaatttatgacatcaggcactttttcaaatagagcggacatgttaaggtacaaccatcgatttctatcaatttgaaataaaaggagcgctgttatgcaaattaaagaaatttttatgatccgctgcatttcgtgcttaagtgtcgtcttgctccatatcatttcaatggtcctgatgcttcaggcagaagctcttgcagatatttctcacactgttgattctttccgcacactcctgatgttcagcacgcccgcttttattttcatctctgaatttttactggcccgttcttatcctgatggggtgcctgacggttttttaaagaagcggggaaaagtgatttttgttccttttttatttatcgcggccatcgatgcgctgctgatgaccagtgcgatggggggagaggtaacctttctcgcgtttgtgcaaaaatatctggcgaacgttttcttaggaaactttatcggatacttcattctcgtcatctttcaattttacatgctgcatatgatgtttcatgagtacttgaaaaaagcatcgccgaaatgggtgctgtctatctcatttgtggtgacagccgcttatttaggctatttctccgcagccagcccggctcctgcttctgaagagggaggggcatttccgttcttctgggttccgttcgcaggctggcttttctacttttgtctagcctactattgcggaaaagaatacaagcgttttttagcgctgctgaaccaataccgctgggtggtgtacggcggcgcaattgcttccggggcgctggttgtcactgtttcttatgtgggtgaaatcggcatgatcagctcgaagcggcctgatatcatgctgtattcaacaagcatgattttcctgtgttttcacttgttttccaaaatgaagcatgtgccgaaaatcatgatgtttatcagcaactattccttttcgatttatctgcttcatgcctattttatgattataggctacgtgttgcttttgaatatgcccgacattcctgccgtaccggctgttctcctgttgtttgccgtgtgcacagccggcccgattatgacttcatgggcgctgaataagttcaaatatgggtatttatttgtggggaaaatttatcagccaaaacagaagaaggtaacagtcgaagtgcgtgatcacgcagggtgaaaaacaagcggcaggggggatcctgccgcttgttgtgtattaaaacatacagtatacacaatctttttcttgtaaaataaaggagaagagtgaatagaagggagaacattcatgacatcagtcaatctaagctacccaataggagaatacaaggcgagggaatccgtatcgaaggagcaaaaagataaatggattcaagtacttgaagaagtgccggcaaaattgaagcaagctgtagagggcatgacggacagccagcttgacacaccgtaccgggacggtggatggaccgttcggcaagttgttcatcatctggctgacagtcatatgaacagctatattcgttttaaattgagcttgacggaagagacaccggctattcgtccgtatgatgaaaaagcatggtcggagctaaaagactcgaaaacggcagatccgagcggctcactcgcgcttttgcaggagcttcacggaagatggacggctctgctccgcactctgacggatcagcaatttaagcgcggattttatcaccctgatacaaaggagatcattaccctggagaacgcgctcggcctgtatgtctggcactcacatcatcatatcgctcatattacggagctttccagacggatggggtggtcttaacgcttttgccggcggaaagccggaatactgatagcagcaatcaccagaagtgagatcacagcagccgctgcatataactgatcatagccgctggcgacactcgcatgaatggcgtcgcttatcgcggttttgacttcaggaacgggaatgcgttcgatttgttcttgtaaagaagaaacatcagaactgtcgatctccggaatcatctgcatcgccttttctgaatatccgctgtccgataagcggctgttgatctcatcacctatttggtcaaacccggctgtgataaaacctgcataaagagtaggcgccaaggtcagtccaatttgccttactaatgaaagcgtgccaagagctgtacccttatttgtttttgccgcttctgatacaaggacgttcagcggagcgcctaacagaaagccaaaaccgatcccagctgccacacttgcgatcataaactcccatttttccgtcacccagaacggaaataaagcaaaccccgcacatgagatgattcccgaaagaataacggtttttacaggacctttttggtcggtaagcgctccgccaagccaagcgccgattccggaagccaacgcaagcggtgtcatccaatagcctgcttttgcggcagggacacccaaatactgttcgacatatgacgggataaaaatgactgccgccaagagccccccggataacaaaccgatgataagcgtgcgctgaaacatatggtttcgcagcagagaatacgccaaaatgggatcgcctcctcgcatttcaactctcttttcatacgagataagcgctgcaaaacagagtatgccaaaaataatacatccataaacctccggattccccaagctgtgtaagagatttgccccgtcaagattggtcatgccgtacatcacagctaaaatcgacagggacaaaaggaagattccggccgcatcgaggcgcttagcctcaggtgcttttgtttccgcgataaaacatgcgccgaaaacaaccaatagcacggcaatcggcaaattaatcaaaaacagccaatgccaagacccggtccaatcaagcagaaagcttccgatatttggcccgagcacagcggccatcccgttcattgcgccaagcagcccaagcgccttcccttgtttttcctttgggagggtcgcgagaatgtgagagctgccgatgatgaaaatcccgccgcctccaagcgcctgaatcagccgcgatatcagaaagagcgggaagctttggctcaaagcaacaagcaaagaaccaagtccgaacaggcaaacctcaatgagaaagagtttttttctgccgtagcggtcggaaagctttccgacgattggcacactgacgctaagaccgagcgtataaagggtaatgccccatgatccccaggaaggggaaacggaaaacgactcgtttatcgttgttaaggcagctgaaataattccgttatctagcgcagccataaatacaccaatcgtaaacaggctgatcgcccacttttggcctttctgctctgttaatgcttcagacatattcatcaacctcctttttattcactcaaagtatattattcattttaaatgaactaaatgtcaaataaaaaaagcctgctcccgcagtttgcggatgacagacttacagatttattcttttttcgctttctctaatgctcttgaaaggatagacagcccttcggaaaccgcctgcttttcttcaggggacagcagctctaatgaacgcttcaatttcaggtggcctttttcatacaaaccccggaaaatatttttcgcattttctgtcaactgaacaactacagagcggcggtcctcttcagaatgtgagcgtttgacaaaccctgatttctcaaggcggtcaagcagcccagttgtattggacagggaagcccccattttttcagcaatgtcgctcactttcaatgttccatggttgtttaatagcatcagcactttcatttgcggcatgctcatatccagcttcatccactcggacacatcaccgaggccggcggaagttaagactttcatatagagcacccatatttcccgttcctccgatgaaagaatgttttcgtttaatactgttgtatcgtgtaaattatattccatttcatcacttcctcatcattcactcctcttaccatattactcgattttcactcctgaaagaaagtgagcagaaaccgcatgcgggactttgtccgaaaaataacggtagtgtataatgagttggagattattgggggagaggatcgaactagaatatgattggagagaccattgctgattaaaaagaatgctttatcaatattaaaaatcgtttttcctattgctgttttgctatttgttatttatcaatcgaaaaaagaactgacaaatctgtcattcaaacgtacgctcatggtcatcaacggactggaacgaactgacttatttatgcttgtgttgatcggcttgctggctgttgcggccatgtcgctgtatgattacgtcctgaaatactcacttcgcctatcgatcacaaacggaaaagtattcagggtttcctggatcgccaattcatttaataatgtgctgggcttcggcggtttagccggcgtcgggttaagaatgatgttatataaggagcatacgaaagaccataaggcactcgtgaaaggaatcgcctggctcacatcatctatgctgctcggattatctgttttcagcattttcgtcgctgcgagaatgctgccagtggatgaagtgattcatgaaaagccttggctatgggcggtcgttatcggttttgcgctgatattgccgctgtctttggcggtgtccaaaataaaagaccgcaaagctggggacgaagagaatgcggacaaagtgaaaaatccgattttcgcatatattggagcttcagttgttgaatggctcatggccgggatcgtcatctattttgctttgttcgctatgggcattcatgcagatatcaggtatgtgttcggggtgttcgtcattgcggcgatcggaggaatgatcagcctcgtgccgggcggcttcggctcgtttgaccttttatttttgctgggaatggagcagcttggctatcatcaagaggccatcgttacttctattgtgttgtacaggctcgcctactcatttatcccatttatcttgggactgttctttgccgcaggcgacctgacggaaaatacaatgaagcggctcgaaacgaacccgcgcattgcaccggcaattgagacgacaaacgttctgcttgttgttcagcgtgcggtattagtgagaattttgcaaggctcgctttcccttattgtgttcgtagcaggtctgattgtcctggcctcagtttccttgccgattgaccggctgacggttataccgcacattccgcgcccggcgcttttgctgttcaacggcctgtccttaagctcagcgctcattctgctgattctgccgatcgagctttataaacggacaaaacgttcctatacgatggccattacagcgcttgtcggcggctttgtgttcagctttttaaaagggcttaacatcagcgcgatattcgtattgccgatgattatcgtattgcttgtgctattgaaaaaacaatttgtccgcgaacaggcatcctatacactgggacaattaatattcgctgtggcgctgtttactgtggcgctctttaactacaatctgatcgcgggctttatttgggaccggatgaagaaggtgctgcgtcacgaatatttcgtccacagcacctcgcatattacacatgcaaccatcatggcgatcattattgtgccgctgttcttcttgatatttacagtggtctatcataagagaacgaaaccgatcggagagaaagctgatcctgagcgtcttgctgcgtttctcaatgaaaaaggcggcaacgcgctgagccatctcggttttcttggagataagcggttttatttttccagcgatgggaatgcactgcttctgtttgggaaaatcgccagaaggctggtcgtgctcggcgatccgtctggccaaagagaatcattcccgctcgtgctggaagaatttctgaacgaagcgcatcagaagggattcagtgttttgttctatcaaattgaacgagaggacatggcgctgtatcacgattttggctacaacttctttaaattgggcgaggaagcatatgtagatttaaatacatttaccttgactgggaagaaaaaagccggccttcgggcaatcaataaccgctttgagcgggaggagtatactttccatgtggatcatcccccattttctgatgcgtttttggaggagctgaagcaaatctcagacgaatggctcggctcgaaaaaagagaagggattctcgctcggattttttgatccttcctatttacagaaagcgccgatcgcctatatgaaaaatgcagaaggagagatcgttgcattcgcaaatgtcatgccgatgtaccaggaaggagagatatcggttgatctgatgcgctatcgcggcgacgctccaaatggcattatggacgcattgttcatccgcatgtttttatgggcaaaggaagagggctgcacgtcttttaatatgggaatggcacccttggccaatgttggcactgcctttacatccttctggtccgaaaggtttgccgctgtcatttttaataatgtcagatacatgtacagcttcagcggcctaagagcctttaaagaaaaatacaaaccggagtggcgagggaaatacttggcgtatcggaaaaacagatctctttctgtcaccatgttcctcgttacacgtctgattggcaaaagcaaaaaagactccgtctaataagacggagtcttttttttatttcgtttttaagaagtaggtttcaatatcatcaagcagatagtttgcggctttaattccgcctgcggttgtccacacgacgtcatcgacttcatgtgcattacctgacttcacggcctttaggtttttccatagtgaactgcttgtccactgattggcccatttttcattttcctttgcattatcggctttataagtgaaataaaacagcacatcagcatccatatcaggaatagattctttactgtcggttgagaacgtaaattggtccttttgtttcttaaacagctccacttgtttttcagggcgtttgaagccaagctggtctaaaataatcccaggaaatgaatcggtataatagattcttgactcaccggataaaaagcgtacgacagaaacggttttgtttgtctggtcgcccagcttgttttttaaatcagaaacgcgtttatcaaaatcggcaatgacttccttgcttttgtccgccttattcaccgcgttggcgtatagagtcaggttatccttccagttcccggccaaagattcagcaaaaacagtcggcgcaatcgcatttaactgatcataaattttctcctggcgcactttgtttccaataatcaaatcaggctttaattctgcgatggcttccacattcggttccgtttcaagaccgacgtttttaacacctttcatgtcatctttcagatagtcataccacgggtcgcccttccatgactttacggctccgaccggcttaatgccaagcgctaagagcgcctctgttccttcattagttaaaacaacaatccgttttggattggcggggatgttgtctgatgtccccattgcatgtttgaccgttcttgttttgctgcttgacccctcgctgttgcttgaactttctgaactattacaggcagaaagtaccataaaggccattaaaaatacgaatagcatgctgatatgctttttcatctttttcctcccaatattgaaattcattatcatttagatcataataagcagtgttaagagtgtcaatccctaattgaggattattctcaaaaacaaacattacatagtaaataactaggagaatattagatcatgatctgcaaaaaggcatcttcaaaatggattgtgttagtatgtctgattttcattttactggcggctgtctgcgcaagcgtcgtgtatggctatacaggtacgtcatggagacaggtctatcaggcgtttacttccttcaacggaacaaatgagcatgtcatcatcaaggatgtcaggcttccgcgcgctttggttgcgacagtcgtcggcgcctcgcttgcagccgcgggcgctctcatgcaggcgctcacaaaaaatccgcttgcgtcaccggggattttcgggattaacgccggtgcaggtttttttattgttgccggatcgttttttctgcatattcagtcacctcaggcgctagtatggagctcgtttcttggggcagcatttaccgctgcgatcgtctatgcagcaggctcgcttggaagagaaggactgacgccaatcaaactgacgctggcgggagctgccatggcagccatgttttcttctctgacacaaggcttgctttctgtcaacgaactcgagcttgcccaggtgcttttttggctgactggctctgtgcagggccggagtctggatctgttgatgacgatgtttccatatgcagcggcagcgctggtaatctgcttctttctcggccaaaaaattaacctcctcgttatgggagaagatgtggcaaaaggactcggccaaaaaacgggcctgctgaaatttgtgatggcgctttgtgttgtcatgcttgcagggtccgctgtcgccattgccgggccgatttcttttatcggcatcattattccgcattttgcccgctttgtcgttggtaatgattatcgctgggttctgccattttccgctgttttgggtgccattttgcttgtttgcgcggatatcggtgcgcgatatatcattatgcctcaggaagttcctgtcggggtcatgaccgccatcatcggaatgcctgtgtttgtgtacatcgcaagaagggggcgaagctatgaaacttcgttttggcgttactgcggctgaaaagaaagcatggatcgtctttttgattttactgggttaacagctgcggtactcatcataagcgctggtctcggacaaaggtttattcctccctgggatgtagcaaaaacattctttggtgcaggttccaagctggatgaactgatgatcatgtcgttccgcatgccaagaattttgacggctttatgcgccggtgtctgcttggcagcggcaggcgcgatattgcaggggctcgtcagaaaccctctcgcatctccggatattatcggaataacaggaggagcggcggtagcggtcgtgcttttaatgatgttcttctcagaccgcagcagttcacttacgatcagtctgtcatggcttccagcagccgcatttatcggcgcatcggctgtcgggctcatcgtctatttactggcatacaaaaatggcgcctccacatttcggctggtgcttatcggaatcggattttcaatgtcggcgcaggcgatgactaccctgttgatgatcaaaggcccgatttaccgagcatcacaagccaatgtgtatatcactgggtcagtttatgggtcaaactggcagcatgtaaaaatagctattatcttatctgtcattctcttattcatttgttttgtcgcgctaaaaaatatgaatatacaggtgctgggtgaagatattgcggcgggtgcaggaagcgctgtgcagcgaaatcgttttttcttgctacttttgagtacggctcttactggttgtgcagtttcagttgccggcacaatcggttttgtcgggctgatggcgccccatattgcaagacggcttgtcggctcatcttatggcgcgctgctcccagcgtcggcacttattggagctctgctcgttttaacagctgatatcgtcggcagaaccttatttgctccggtggaagtgccggccggcgtctttacagcggctatcggcgcaccttattttatttatttgctctataaaacaagaaattcttaatcgttacacccattttcttaaaaaagaaaatgggtttttttgataatgactgaagattcgtaattatttttgctatactgacagagacattgataaagaaagggcggcagatgaatgaaagaagcagaggtattaaaatatgaagcatttacaagcagtcccggcaaaggaaaccccgcaggcgtcgttttgcagggagacgattatacggaagacgagatgcagatcatagctgagcgtgccgggtattcagaaacctcctttatccgaaaaagcgagtcggccgatcttgaactccgttactttacacctggacacgaaatgaatttgtgcggtcatgcgacagttgcttctctttacgcattatgtgagaaaagaatgctggagagcggtaaaacgtacagcatccaaacgaaagcgggtatcctgcctgtgaagatttctgaaaaagatggccgtattcatatcacgcttgaacaggcctctccgcaattcaaaccatttacaggcgatcggggaaaacttgcgaccgcactgggtatcaccgatgaagattttcatgaagaccttccgattgtgtttggcagcactggcatatggacagccatcgttccgcttaaatcattggaggcttccaaaaaaatggtgccagataacaaacaatttccggaagtgttaattgatctgccaaaagcttcagtccatccgtttacctttgaaaccgttcatcccgacagcgacctgcacggacgccacttttcatccccgtattcgggaacgattgaagaccccgtgaccggcacagcatccggcgtgatgggggcttatatgaaacattatggaaatgccgagcagcataaatttatcattgaacaagggcaggaaattggaaaagacggaaaagtggagatcgaaatgaacgaagccggcggccatgtgaaagtgaacatgacaggaacagccgtttactcagaaacccgtattcttaaattctaatacggatgatggtttacaaaaagatgcactttccgttattattatgaaatgataatcattttcaattgcataggaaggtgagacggtatgcctcaaaccgaacaaatacatcagcattcagtactgcgggacatcatacgcagcagaagatcgattcgaaagtttaaacaagagccagtaccttcagcagtcattcttgacatgcttgaaacggcaaaatatgcgccaaatcacagagtgacagagccatggagatttatttacgtttccagtgagacaggtaaagcgaacctcatcaatacatttgcagcgttctctaagaaatccaagccggatatgacagaggaaaagcttcaaaatttcaaaaacacacttgggcgcgttccgggatttctgctcgtcgtgtttcaggaagatgaaaacgaaagagcgcgggacgacgattttgcggcaacaagctcgttgattcaaaatctccagcttcttgcttgggaaaaaggaatcggcatggtttggaaaagcggaaaaatcctttatgacaaagaagtccatcaggcctttggtttgcaggataatgagcgtttcgccgccatcatacaaacaggttatcctgacgaggcgccggaagtgaaaaaacgcacaccgatccgcgaccggtttactgaaatgtaaaaagccccttgtctcaaacggagacaagggtttttcattaacgagatttctttttcgctctgttgtcggctgctttcgcacgctcttgcgcttcgcgatcatctgcatcagcaagctcggttgaatattcttcgtaaacgccgtcagtttccctttttaatgtatcgggaacttgtggaagcttttgtttgtttttatcacggtttttgtggatatgatttctgcccatatcaaattccccctaaaaagtgatatcaaacaaatatagtatttggttttaaggggttatgtattcctacttccgcttagcagctttttccgcttttttaaattcgcctgaataaagaacttcctgcatttttttcaggttggcgccttgctggtgcttctccctctttttttccataaaaaggacctccttcaaccatgttattcttaaggttgacgcttcctgctgtttttatacagtctttcggtccgctatcagctgtgagagtgcaaattcaagatccgaatatgtaaaacgaaatccagaggttatcgcttttttaggaagagcgcgctgtcctttcacaatcaaaagactcatttcacccaatgcttttgataaaaagaattccgggacggggagccaatgcgggcggtgcttcacccgtgcaatcgcttttccgaattgcttcatgtccacaggattgggcgcggtgacattcattgggcctgagatgccggcattttccaccgcatatcggatcatctgggccgcatcctcgacatgaatccatgacagccactgccttcccgttccaatcgttccgccggccagaaacttataggggagaaccataagcggtagagcacctttttctccaagcatcacgccaaatcttgcataaaccgtccggatgcccatcgcttcaatatgctgtccttccttttcccacaggtgtgcagtatggctgagaaaatcctcatctgacgttgcagaatcctctgtgaaagttttctcaaggcttgtcccgtaaatacccacggcactggcttggatcaatgtcttcggcttctccttctgtttctgaataagccgctgcacttcacgcgtcgcattgatacggctggagagaatgtgctgcttcgttttttctgtccagcggccaaaaatcgattttcccgcaaggtttatccagacatcaatatgaggaagttcctgctccggggcggctccttccgtcagccattggacatatgtcatatttttttgttcagtttcccttgcgtttcttgataaaatataaacatggtgtccctggcggataagaacgcctgtcagatgctggccgagaaaaccggttccgcccgtcattgcgatattcatgaacatctctcctcatcgttctaataaatatactttacctcattgtaataaaagaaaacgcgtttcaggcctgagaagggagattaagatgccgtttattacaaaaatatcaacgcaaaaaaagaatacggaacgcttcaatatttttctggatgataaatacgccttcagcgtggacgcggatgtgctcgtgaaatttgagctcaagaagggaaaagaactcgatgatcttgacatcattgagattcaatacggcgatgaagtgaagaaaggcttcaaccgtgcgcttgactttttatcctatcgaatgcggtcgacgaaagaggtcgaggaccacttaaagaaaaaagaaacctcgccccccgtcattgcggaagtcatccataggcttaacgattacaagtacttaaacgaccaggaatttgcctcagcctatgtcagcactcacaaaaaaacaaacggaaaaggccctgatgttttgttcagagagctaagagcgaagggaattgatgccgatacaattaaggaggcgctaagttccttttcctttgaagatcagacaagagaagcggtcaagcatgttgaaaagcttctcaaaaaagataaaaagctttcgacgaaagaattcaaacagcgcgcccagctgcagcttcagcgcaagggcttctcatttgatgttatcagcgcggcgatggatcagattgaatatgaaaatgatgaagacacagagaaagaagcgctgcgccttcacgcggaaaaagcgtttagaaaataccgctatgacggctcatatgaaagcgccatgaaggtcaaacaatttttattccgcaaaggattctcactcgatttaatcgagcaattactgcaggaagaggagtactgaaatggagaaacgatacagtcaaatgacacctcacgaactcaataccgaaatcgcattactttctgaaaaagcaagaaaagccgaacagcatggaatcataaacgaactggcagtgctcgaacggaaaattacgatggcaaaagcatatttgctgaacccggaagattactcaccgggagaaacatatcgtgtggaaaacactgaggacgagtttaccatcagttatttaaatggcgttttcgcatggggatacagaacctcttcccctcagcaagaggaagcgctgccaatctcagtattgcaagaaaaagaataaagcgtaacaggaggctgattatcagcctctttttgtttgcagcacatttacacgaattcttaaagaaaaaatcattgaattcacttgaaaaatcttttaagatgaaactcgttgttttttaaaatcaaaggaggcgatgacgttgagtatcaaaaacccatctgtaaaatttattatatttgttcttatgatttgtacattttcaatcggctatacagaatacgcggtgatgggtattttgacgtcgattgccaatgactttcatatacaggtttcatccgcagggcttcttgtcacggcttatgcggctagcgtttgtttgacaggaccgctcgtcaccatcatttccgtcaagcttccgagaaagcctgtgcttcttgggctgatggcggtttttatcctttccaacctgatgagcgcactggcgccgaattttgcggtattggccatttcaagaattttatctgcgtccattcacggcgctttcttcgcgattgccatggtattcgcaagtgaaatggttccgccggaaaagcgtgctgcagctgctgcttcaatgaacggcggactgacagtggctctaatgcttggtgttccattcggctcttatctcggagatgtcctgaattggagagcggtgttttccatcattacggctcttggtgtcatcggatttttaggccttatggctgccgtgccgaacagaaaaccaaaagtgatcccaatgcttatgaatgagtggggggtttttaaacacaaacaagtgctgttttccttcgcgattaccattttaggctattccggtgtctttatcgcctacacctttatcgaacccattttgaggcattcagccggattcagcacggttggcattacaggtgctctctttgcgtatggattgggaggcgttgccgggaatttctttgctggaaaggtaccgctgcctttgctgactcggacgatgatcggcgtaatgatcggtttaatcggtgttctggctgtatttccttacatcgccatttacccggctgcagccattgtggcaacgttcctattcggggcatgcgcattcggcacgccgcctcttctgcaaacaaaggtcatttcctcatctgagggcggcacaaccattgccgcagctgtcagcgtatcagcatttaaccttgccaatgcccttggtgcatggatcggcggaatgattttaaacggaacaggctcttattcctggctgtttgcaggaggtgcgcttatgaccgcatgcggacttgtgctttctaccttcgcacacttatcagaaaagaagagcgtctacgaatatcaagtcaataaagggtaaaaaacagctgcagtgtatgcagctgttcttctttaccgtttgcctgaggctctcattctttcttgaggatgctgattgatagatccgtcagcacgctttgaagcatagtcgtcctttgctctcggttcaccctgaaatttgttttcgttttcgtaaggaaatcctttttctttatttcggaccatgtcatatccccctaggttcgagatcaaaaagttgcgtcttttcagatgaagacgtaaggttagtatatggagaacaccacgtaataaagcgttatttttttcctgaagaaaggagactgcacacatgaatatgtacattgagaaactgactaatctgcttctggaaaagaacgagatgatcagctatatacaggcaaaaacgtgggtggaattgttatggagcgatttcgaagcaacctacgcaaaagccggacacgcctatcaaggtgaaaaaatgactgaaaaaatcgtcacacaatggattgaaaactatggcggccagctccacctttttcaaagctcccgtaacgacgtgaatgattacttaaatcaaagcagaggccttttgcattaaaaacctgccgttaacgaccggcaggttttttcattttcttaaaattaccttaacaggaagaaatcataaacaaaacatgtttcaccagcctgtcaatcagggaataccacttatatcttgtcaaaatgcgaggaggagctttatatgaaaaagaaacaagtaatgctcgctttaacagctgccgcaggactgggtttgacagcacttcattccgctcccgcagcaaaagctgcgccccttcacgacatatctgtcagcatgccatcatccgatacttacatcataaaagcaggaaaactgaatgtccggactgagccaaatcatgaaggtgatattctcggcactgtatcatcagaacaaaaggtaaaagtcgataggttcgtaaatgccgattgggctcaaattcatttcaaaggaaagaaagcatatatttcaactcactttttaatgaaaaccgcaagccaagcgaaaacaacgaaacagacagccttctatgcaccgacgcccgaaaatggaaaagctaaacagctctcatctggaacagaggtgacaatacttgggtggggattcagtgaaaacggcggatttgacttcacttgggggttcgtggattatggcggagttaaaggctatattcacacaaaggatttacaaatgcgataaaaaggcaggccgaggcttgtctttttgcctatgcatgaaacatttcttctttctgcacgtaacaatgagaaaggagatgatgatatgacgggtttagtcggcggagggcttatgatcattgcgggcatactgatcaaactgtttcctcccaaatcgatcaacagtgtgtacggatacagaacgagacgctcaatgtcagatcaaagattatggaatgaagcgaaccgttacagtgcatcattaatgatcctgtcaggcttggtgattgcgggaatgggtttgctgctgggatcaaacttgtttattcttcagcttatcctgctgattgccgccagtgtcataacatttatgctaacggagaaaaggctgaaaatcatgacgcacagtcaaggaggagatagaagtggacggagttaaatgccagtttgtcaatacgaacggaatcacgctccacgttgcagccgcaggaccggaagacggcccgttaattgtcctgctccatggatttcctgagttttggtacggctggaaaaatcaaatcaaaccgcttgttgatgcgggttaccgggtcattgctcctgatcagcggggctacaatctcagtgacaaaccggaaggaattgattcgtatcggattgatacattaagagatgatatcatcgggcttattacgcaattcactgatgaaaaagcaattgtcatcgggcatgactggggaggggctgttgcatggcatttggcttccacacgcccggaatatcttgaaaaactgatcgcgatcaatattccgcacccgcacgtcatgaaaaccgtaacgccgctttatccgccgcaatggctgaaaagctcgtatatcgcatacttccagctccccgatataccggaggcatcactaaaggaaaatgattatgaaacattagacaaagcgattggattatccgaccgtcccgcgctttttacatccgaggatgtcagcaggtacaaagaagcgtggaaacagccgggcgcactgacagctatgctgaactggtacagagccctcagaaaaggaagcttggcagagaaaccctcttacgaaacagtaccttaccgaatgatctggggaatggaagaccgctttttgagcaggaagcttgcgaaagagacggaaaggcattgcccgaatggacatctcatctttgttgatgaagcttcccattggattaaccacgaaaagccagccatcgtcaatcagctgattttggaatatcttaagaaccaataagctaaaatttctctccatccgtctgtcataatggcagactttttctgtgcgtttttttcatagtctgttttaaacatgacaaaataacattaaaaatcatgaatgtcaccataaaattgtaacaaaaaacaggtttaaacgactttaaaaaaaggaatagccttactgaagatttgtgtaaaactcccctaaggcaatacttaaaaagaataataaaaagaaggtgccttaatgaagcaaggattaatctcgattattatcccgtcttacaatgaagggtataatgtcaaactcattcatgaatctttaaaaaaggaatttaaaaacatttattatgactatgaaatattcttcataaacgacggaagtgttgatgacacgcttcagcagatcaaagacttggcagcgacgtgcagccgggtaaaatatatatctttttctcgaaactttggaaaagaagccgcaattttggcgggctttgagcatgttcagggcgaggcggttattgtaatggatgccgatctgcagcatccgacatatttgctgaaggaatttatcaaaggctacgaagaagggtatgaccaagtcattgcccaaaggaacagaaaaggggacagctttgtccgctcactcttatcatctatgtattacaagttcattaataaagcggtggaagtcgatttgcgtgacggtgtcggtgacttcagattgttaagccgccaagctgtgaatgcacttttgaagctgagcgaaggaaaccgcttttcaaaaggccttttttgctggattggctttgatcagaaaattgtattttatgaaaatgtcgaacgaaaaaacggcacctccaaatggtcgttcagcagtctgtttaactacggaatggacggcgtcgtttcatttaatcataagccgctgagattatgtttttatacaggcattttcatcctgctgctttccatcatttatatcattgccacattcgttaaaattctgactaacggtatttctgtgcctgggtatttcaccattatctcagcagtgttatttctcggcggagtacagctgttaagccttggaattataggtgaatatatcggccgaatctattatgaaacaaaaaaacgcccgcattatttgatcaaagaggcgaatatcccgaacaaagacctgcctgaaacgaacgaattaaaaagcatgcggcgtctgacaaaaatgcactgaaaataccaagcgccattggcagtgctttttttgcgtgtctattatcttaaaagcaagactggagaatttatatgaaaagaaaacatatcatgatctatgcggccagtttgctggtgtccgttctggcacacgctttttttgtgaaagaatgggcggaaggcaggtatatgacaggtccgggtgacgggcttgcgcaaatgatcgtatttaaaaaattattatttgaccaatatacacacgggaattttttctacaattattcattcggacttggcggcggcacattcagtcagctcggctattatttttccgcgtcttttctttttcttgctgtgtccgccgctgtttggctgcttcaagccgtccagctgatcggagaagcggatacgcttttttgggcagagtcagctgttttcatcagtatttttaaattgagcttgatcatctttacgtccgcttctgtttttcattatcttcttaagcacagggcggcatcgttcacgggagccgtgttatacggcgtctcaattatttatttccgtcacgaagcgtattgggaatttttcaccgatacaatggtttggcttccgctgcttgtgcttggtgcagaaaaaattattagagagcggcgtccggcgtggtttatcgttgcgtgttcgctgacgttaatcaacaatttttactttgcatacataaaccttatattcatcggaatctatgtgctgttcagatggctgatccgtttggaaccacatgaagagaaaagatggattcaaatcagattatttctcgtttcaggcttcatttcttttggcatcagtgcggcggcgtttgtgccggtagtatacggttttttaaacaacctgcgccctccatacagccagaaaatagagtggctcaatttcgatgataatatcttattttcgagccggatcatcattgtgccggccgcttttctgctgtttttgtttattatttctttttacaaaaaccgtgtgtttcgtctctttgccgggttgagcctgctgtttattctgtttcatttcagtccgtatgcggcaagcgtctttaacggtttttccgccccgcaaaaccggtttgaatatgttctggcctttaccattgcgggagcagctgcggctggtttgtcacagctgtctgaattgaaacggaaagaactgctcccggccgcagctgtcgtcctgcttctttacttgtatcatattcaaaggtataagctcgatatatggaagcctgcgaatgaaagtattctattgctcttactcatgacaatcgcagccttgtttgctgcagcttttgcgaaaaaacgggcaaaaatggctgtgtacggtataatcattctttcttcgctgtttgtcgccaactcctatcaaaaatacgcgctctcagaaggcggcgatttggatagtgtgacaaaagaatatcttacaagtgaggaatacagagggcgggaatcatctgagctcatcagacgtttacagaaggaagacgatgatccgctcatgagaatcgactggatgaacggggtccgcaataatacgccaatcatttacggatttaatggcttcagcgcgtattccagcattttaaacaaagatctgctggccttctattggaatgatttaagcatcgatatgggcagggaaagcgtcagccgttacgcgtcattgggagacagggcgaatttatacagcctgctttacggcaaatattatatgaccgaaaaaacaaacgaagccagcgtcccgtacggattcaaaaagcatttagaaacagagcattatgcagtttatgagaatcagtacatgcttccattcgtcaaaacagcggatgccatatacagcgaaagtgagctggaccgattgcccgctcttgcgaaagaacaggcgatgctgaaaggaattatattaaaagatccatcaggaaaaacggagcagacaccaaaaccgtccaatttgatcaccaagtcggacatcaccgcaaaacaagcccagtatcaaaacgggctgctaaccgtaactggagaaaacggaggagagctgatcatcaccccgaaacagccatcatccgctgcgggagactactatgtcagcttttatttgaaaagcaaagcaaaagacaaaggatttacgttaaaggtaaatgattatgtcacaacaaggaaatcgaacaaatcgatctataaaaccggagtaaataatataacggtaagagtgcctaaatcaggccatatctcaatcaatcttccgaaaggaacctatgagctgagaaacatagcgctctatgaagaaaattaccaaacgctgaaaaacgctgtaatgcaaaataaaacagagaaagcagacaaactgaattggaacaaaaatcgactgacctttgcctatcatctgtcaaaagaccagtacatcatgcttccgatcccatatgaaaaaggctgggagctgaagatcaacggaaaaacacagaagatcgaaaaagcggattatgcttttataggcttcaaggcgcaaaagggagacaatcacattgagctgacttactatccgccatacttcaaaatatcggcggtcatatctctcgtcagtctgctgtttgctgttttctatataagacgtaaaaagcccggctctatatagagccgagctttaattttttctgaagtttttcttcgctgaatatccatcccgtataggacgaacgaatcgtgagatcatggccgatgtgaacaattgcgacaaacggataatggcctttgctccgataacgcaggtcgataaatctcacctcataatgatctttaaacgtatccacttcccaccggtataccggagaaaaggacagaaacgccgcaatgttatcatcctgctttgccgcatgcattacatcggtttcaggaacaggcacccgattaaatgtatccagaatcacgacatgtccttccatgcttcttcctacatagaaagcatgtgctgtcgtcactgcgattcgccattgcctgaatttcatcgttggagaaataataatgctttcgatctcatcatgaatcatctcatgaagcttccgtttaattctcagctgcatgatcaggcgcaccaagtagtagcctaccaatatgatatataagctgagaaacgtgatgccgggactcccgcctgcataccaaatcgcgatagctgctagatggctgataaaaataaacggatcaaacgtattaatcagcccgagcgcaacccattttttcgaaaatggacgaatggcttgtgttccataggcgttgaatatatcaacaaagacatgcagaacgactgccagcagtgtccacagccacaggtgcagaaaatcggcctgaggataaaataaatacagaatcgccgggatgatgacagaccaaaacaaaacggcgggaattgaatgggtaaatcctctgtgattccttatataaacagcattgtttttaagctttaacacagtatcaatatccggagcctgagagcccgcaagcgttgcgatcataacagcgtgagccattgccggatctgatccgacaacaggatcaagcgtcgcaataccgcccagtgcgatgcccataacgacatgtgtgcccgtatccataggtgacctccttgcaggatgatcctgcacattcactttgtaagaaattccccattttcatatacccaatttttaaactgattcaatcgttctcatatgtttccgctttttctttattactatttaatgtaacatattatcgtactgtgcccttagtgtacaacaaaaaacagtctaaagaaaagcggggcgcgaaagactggggagaaacacatatgaacgtacttgaagacaaattaaaacaaaaagacatacagcaatttcgcgatgatttaatctcatggtttgaacgagagcagcgcgttctgccgtggagagaggaccaagatccatataaggtgtgggtatctgaagtgatgctgcagcaaacgagagtagagacagtgattccttactttctccggtttgtggaacaattcccgacagtggaagcgctcgctgatgctgatgaagaaaaggtgctgaaagcatgggaagggctcggctattattcgcgagtcagaaacctgcaaagcgcggtaaaagaagtgaaacaggaatacggcggcattgtccctccagacgagaaagattttggcgggttaaaaggcgtcggcccttatacaaagggagcggtgctcagcattgcctacaataaacccattcccgcggttgatggaaatgtgatgcgtgtcatgtccagaattctttctatttgggatgatattgccaaaccaaaaacaagaacgatctttgaagacgccatacgagcttttatttccaaagaaaaaccatctgaatttaatcagggcttgatggagcttggagccttgatctgtacgccaaaatcaccctcatgcctgctatgcccggttcagcagcattgctcagcatttgaagaaggcactgaacgggagcttccggtaaaaagcaaaaagaaaaagcccgggatcaaaaccatggccgcgatcgtactgactgatgaagacggacaagtgtatatccacaaacggccgtctaaaggtttgctcgccaacctgtgggaattcccgaatcttgaaacacaaaaagggatcaaaactgagcgtgaacagctcattgctttcttagaaaacgaatatggcatacaagctgatatcagtgatctgcaaggtgtagtcgagcatgttttcacccacctggtatggaatatttcagtgtttttcggtaaagtaaaacaagtgtcggataccagcgagctgaaaaaagtatcgaaagaagagctcgaacaatttgctttcccggtgtcacatcaaaaaatctggaagatggcagtagaagcagccgccatctcggctgctccgtaaaccattcttaatcgtaagagacgcgcgtgccgtggctgtagtccgcttcattgcgcttcattccgccgcgcgcttcaatttcttgcgttaattcccggtattttgattggccttcttcgttcaaataaggcataatttgctgaaaggcatgatgaaaataagcgagttcactgttcttccaatcttttttggaaaccatgttcaattcgctcatatcacgtccgacatacataacagaagaccccctttaaagttcttgccattattgtttgtggaaataaaagaactatacgctacaaggagatgaggaaaaatggaacaaaataaatgtgcactcgtaacaggaagcagccgcggtgtcggaaaagcggccgcgatcagacttgctgagaacggctataacatcgtcattaactatgcacgcagcaaaaaagcagcattagaaacagcggaagaaatcgaaaagcttggcgttaaagtgcttgtcgtaaaagcaaacgtaggacagcctgcaaaaatcaaagaaatgtttcagcaaattgatgaaacgttcggcagacttgatgtttttgtcaataatgccgcttcaggagtactaagacctgtcatggaattagaagaaacacactgggactggacgatgaacattaatgcgaaagcattgcttttctgcgctcaggaagctgccaagctaatggagaagaacggtggcgggcatattgtcagcattagttcattaggctctatccgctatcttgaaaactacaccacggtcggtgtatcaaaagcagcgttagaggctttaacccgttatcttgccgttgagctttcaccaaaacaaattatcgtcaatgctgtttcaggcggagcgatcgacacagatgcgctgaagcacttcccgaatagagaagatctgcttgaggatgcgcgccaaaacacgccggcgggacgcatggtcgaaattaaagacatggttgatactgtggagtttctagtgtcttccaaggctgacatgatccgcggacagacaattatcgttgacggcggacgctcactgctcgtttaaaaatttttaaaaaagaggaatagctatacgatcacctgcacattctaatgaccgtggaggtgataacaatggctaactcaaataacttcagcaaaacaaacgctcaacaagttagaaaacaaaaccaacaatcagctgctggtcaaggtcaatttggcactgaatttgctagcgaaacaaacgctcagcaagtcagaaaacaaaaccagcaatcagctggacaacaaggtcaattcggcactgaattcgctagtgaaactgacgcacagcaggtaagacagcaaaaccaatctgctgaacaaaacaaacaacaaaacagctaatcactgaaacagaaaaaagcacttcatcttcgggtggaagtgcttttttctgtttgaaaaacgacaaaacttgtggaaggtctacagaatgagtcaaagggtttgctttatggagatcgaaatgattaaaggaggaaatgtttatactttcatcaggctgaaggaggaaccgatgaccgaatttgaaaagctggtaagtgaacagatgaaaacgatggataagcttctcgatctccaatcagagctcgaccgctgcaaacaaattgaggcggaactccggcatttggaaagggatgcaaggctgcgtgggattcaggctgaaattgcggtaaaacggaaacaccttgccgatatacaggatatgtttcaaaagcagacagagcaggtcattcgttcatatcgcagctcagaaaagccgtcttcctttgtgtagtgcaggaatgtgccattccccggccggaatggctcttttattttcatttttcaatttgtaacgttataataggtaaaagacgttgtcggtaagcaaatttggacatactaactgtagggctttatagaaagtaggggagaaatatgggctatcccaaggaaggagaaaccattcaaattcacagctataagcacaacgggctgattcatagaatttggaatgagacaacaatcttaaaaagtacagaaatgtgtgtcatcggagccaatgaccggacgatggtaaccgaatcagacggccggacatggataaccagagagcccgcaatctgttattttcacgcaagacaatggtttaatgtcatcgggatgctgagggaagacggggttcattattattgcaacatcagttctccgtttgcctatgatggcgaagcaattaaatatattgattatgacttagatgttaaggtttttcctgacatgacctacaatattctcgatgaagacgaatatgatgatcatcggaaagccatgaattatccaaaagaaatcgacagtattttaagagactacttaaatacgctgctccattggattcaccagcgtcagggaccgtttgcgcccgagtttgtcgatatgtggtatgaacggtatttgcgctatacaaaataatggttacgtaaaaacctgttgcggggtacaacaggtttttcacatgggctcacacacatcatgataaagagagagggggaatcaacgtgggggttatgaaacgctacatgcaattcgtcaaaccttataagaagcaaattttcgttacagtattaatcgggatcgtaaaattctccattccgcttgctctcccattgcttctgaagtacgtagttgacgacattattcaaggaggcggcacggccagtgacaaaaccacgtcattgttcacgattatggcgatcatgttcgccttatttttaattttgcgcccgcctgttgaatattaccggcaatattttgcccagtggactgccagcaaggtgctttatgatataagagctaagctgtttgaccatatacaaaaactgagccttcgtttttacgcgaatacaagaacaggggaagtcatttcccgagtgattaatgatgtagaacaaacaaaggatttcgtcatcacagggctgatgaatatatggctcgatatgctgacgattttgattgtaatctctatcatgctcacactggacgttaaattaacgctgatttctatcgtattattcccattatacggaatatcagtgaagtatttttacggccgtttacgaaagctgacaagggagcgctcacaggctcttgctcaagtgcaggggcatttgcacgaacgcattcaaggcatgcctgtcatcagaagctttgcgatagaagatcatgaacaggctcaatttaatgagaaaaacggtcatttcttagataaagccatccgccacacgaattggaacgccaaaacctttgcggtcgttaataccattacagatttggcgccgctcatcgtcatagcgtgcgccgggtattttgtcattaatggaccgctgacagtcggaacaatggtcgcgtttgtcggatatattgacagaatgtacaaccctgttagaaggctgatcaattcctctacaactttgacacagtcaatcgcatcaatggacagggtgtttgaatttattgacgagccctatgaactcactgacaaaccaaatgcgataaaggccgatcagattcgcggaggagtggagtttcaaaacgtttcgtttcaatatgagaaggacaaagaaaatattcttcatgatgtatccttaaaagtaaatagaggagaaactgtagctctcgtcggcatgagcggaggaggaaaatcaacgctcgtcagcctgatcccaagattttatgatgtaacaagcggcagactgctgattgatgggacggatattcgcgattatgaagcaagaagccttcgcaaccaggttggtatggtgcttcaggatacctttttatttagtgaaacgattcgggaaaatatcgcgatcggcaagcctgatgccacacttgaagagataatcgaagccgccaaagctgcaaatgcccatgaatttatcatgagttttccagaaggatatgagacccgggtgggagaacgaggcgttaagctttcaggcggacaaaagcagcggatctcaattgcgcgggtattcctgaaaaatccgccgctcctcattttagatgaagctacatcagctctggatttggaaagtgagcattacattcaagaagcgatggacaaactggcgaaggatagaacaacttttgttgtcgcccaccgtttatcgacaatcacccatgcggataagattgttgtcatggaaaacggcacaatcattgaaatcggaacccatgatgaactcatggactatgagagccagtacaagcatttatttaccattcaaaatttgaactaaaacatcaatcttatatccttttaacgaaggatataagatttttttgtgtataaaaaaacccggctgtttaaccgggttactcttctgtttctatttcgcagtctttcggatgatacgtttgaaaacttgtgataagtgtttctaaatgttcaagctgctcgcgatattccacggcgcttgccataatattgagcatgttgtaatcaataagctcctcatccgtattctgctgattttttaaaaatgactttgttaaaagctgcttataccggatgccttcttcaaccgcgtcatcatgcggcttgatttttccgacaaacctcatcaaaatccgttcgtgccagtaaagcaggtaatcaagttcttcagtcaatgtttcctgaaactcttccggcatatgatagatctcgttttccagacgatgcagcttcttcaatgtatcaagcgcccgatttgcagtaataatggcctgtctgaacaggacaagctttcttgatttcacataagtcgttttcttaaagtaacttctttcttctttatatagaagatatgtctgatcaagcttgatcattttttctttcagtttttcaatatcctctttcaaaatcgaatgctctgtcgactgccgcatggacaatctgatccacttcataatttcttcggtgttttcgacggtattatgaatcagctttgtttcgtacttaggaggcaaaaacacaaggttgacgataaaggaagaaagcacccctaagatgactgtgcttgttctgatcagcgcgaacattaaaaagtcgtcaccggcagattctaatatcgcaatgactgttacaagagcaattgaaattgtatgttcaattttaagtttcagcatgattgtaatgacaataactgctgttaacccgatcataatcgggctgggtccgaaaataaggccgaacactgtggcaatcacagctccgatgatatttgcttgaacctggtcaataataatgagaaaagagcggtaaatcgacggctggatcgcaaatatcgctgcaattccagcgaaaatcggcgcgggaagcccgatccacgaagccaaataaagggcaagtgtaatcgcaatcccggttttgaaaatgcgggcaccaagtttcattggtttgtgcgtgcattcctttctatagtaaattgtgtgacatagcaaatgggctaatccttaaaattcccggttagtttatttgctaaacaattaagtaatatacagggatcgatacaaatattcaagctatttttctagaaaaagaccaaaatcttacacgttgtttgattccataaaaaaaacaggagctcaaagctcctgttcaaggtatctgattctagtttttaagatgtttaaaagcatcctcgaccgctgcaagcgtgtctttaatatcctgctctgtatgtgctgtggtaataaaccaagcttcatacttagaaggtgctaaattaattccgcgttccagcatcagcttgaaaaacgtagcgaatgtttctccgtcactccgttcagcctgctcgtaattttcgactttctcatcagagaagtataccgtgagcgcaccttttaaccggttgaccgtaatggtgatgccgtgtgtttctgcgtgcttcaaaataccttcctcaagcatagcgccaaggtgatcaagcttttcatacacgcctttttctttgagcacttccagacaagcgatgcctgataggatggaagcggggttccctgccattgttcctgcctgataagcaggtcctagcggagctacctgctccatgatttcttgtttgccgccataggcgccaatcggaagtccgccgccgataattttcccgagtgctgttaaatctggtttcacctgtaagagatcctgcgcgccgccatacataaagcggaaagccgtaatgacttcatcgtaaataacgagagcgcctgcattatgtgtcaattcatttactttttctaagaagccctctttcggctccacgataccgaagttgccgacaatcggttcaacgagaaccgccgcgatttcactgccccatttatcaagagccgctttatagctatcgatatcattaaatggtactgtgatcacttcgtttgcaatgcttttcggtacaccggctgagtctggtgtgccaagagtagacgggccggagcctgcggcgacaagcacaaggtccgaatgcccgtgataacagcccgcaaatttaatgatttttgtccggcttgtatatgcgcgagccacgcggatggtcgtcataacggcttctgtacccgaattgacgaatcttactttgtccatagcgggaatggcttctttgagcatttttgcaaatgtaacctcgtgtttcgttggtgttccatacaatacaccgttctctgccgcttttttaatcgcttctgtaatatgcgggtgggcatgtcctgtaataatcggaccatacgccgctaaataatcgatgtatttgttgccgtccacatcccaaaaataagcgccgcttgctttctccattgcaacaggagaaccgccgccgactgctttatatgatctagacgggctgtttacaccgccgacaatgtgctgtaatgcctcattgtgaagttcaattgattttgtatgcaagaataaaaacctcctatatctccatgcgtcctttctattgtagcatgcttccgaacaagaacaatggcttcgggcttcagattcagctgagatggttgtaatctggacaagaattggatacgcttaataaaaaacatccggaggtaacgtaatgactatagaaatcggacataaagcgcctgatcttgagttaaaaggtgatcatggggaaacagtaaaattatcggattataaaggaaagtacatcgtgctttatttttatccaaaggacatgacaccggggtgtacaactgaagcatgcgattttcgggacagtcacgaaagcttcgctgaactggatgccgtcattatcggcgtcagcccggacagccaggaaaaacacggaaaatttaaagagaagcataaccttccatttctgcttcttgttgatgacgagcataagctggcggaagcatttgatgtgtggaagctgaagaaaaatttcggaaaagagtatatgggaatcgagcgttccacttttttaattgataaagaaggccggctcattaaagaatggagaaaagtaaaagtaaaggaccatgtagccgaagcgcttcaaaccctcaaagatatgtcggaaaagtaaatctctatgagcctatgcttacttttaccctgatatcaattgacaaattatcgtagaaagagttacactaattataaacattacaatgtaagaattttttttagaagagaggtgcatgacggatggctgcacatgaactaaaagaagccttagaaacgttgaaggaaaccggagttcgcattactcctcaacgtcatgcgattctggaatatctcgttaactctatggctcatccaacagcggacgatatatataaagctctggaagggaaatttcctaacatgagcgtagcgacggtatataacaatttgcgtgtgttccgggaatcaggtttggtaaaagagctcacatacggtgatgcttccagcagattcgattttgtcacatccgatcactatcacgcgatttgcgaaaactgcggtaaaattgtggacttccactacccgggccttgatgaagtggagcagctcgctgcccacgtcacgggcttcaaggtaagccaccaccgtttagaaatttacggcgtctgccaagagtgttcgaaaaaagaaaatcattaaaaataagctgaccgcacgaaacggtcagcttattttatttcgacattttctttttattataagactcatcaaattcttttccttctaatcccttatctaaagtcagcggctctcggcaatgcatgcacatatcgactcttcctaaaacctttgtctctttatcacagcctggacaaatgacgcgaaccgctttagtcgaaagcattccgatccaaaagtaaactaccgtgctgagaccgatggataaaagcccaagtatcataaacaaactagaaagcaaaactgactctttgaaaaagatcccgatgtacataatgataaacccaacgaaaaccaaacttaacgcaaatgttctgattttattaattttgctggagtatttcgccatgtccatccccctctgttttaactatagcacaaacccgatgggattttcttcatgttttcggttgaactggaatttacatatggagagttactgtgaaattgtttataatagttcaatgtgtttagaaaaaaggaatttcgttttaaccatagaattgaatcaaatagagaataaaaaaatttgaacaattgcattggaggaatagtgatggaaaatcttctccgtccaatttaccaagaaagagcaagtcaccccaatacattggctgtcattatgattgagagaagaaacaaaacatcttccttaacagataactttgatgcagctttgctggtgattgtaaaggatgctgatgagccagtttttataaagcattatgaatttgatcatcaaacagcttctttgcatgtggtaacagattctcagattcaagaatggattttgcttggaacaaatagaagaatcatagattggattgtaaatggcagagtcttgtttgaccgtaatgaatacgtagttgaactgattgacaggctgaatacatttccgtttgccgaacgtaaactgaagatcggactcgaatacggcaaattaatcagaaggtatgttgaagggaaagctttttttgaagccaatcaatttttagatgcctacaatgccgttgttcatgcgctgcatcatttagcacgtattgaagtaatcgacagaggattccatcccgaaaccacggtgtggagccaagtgcgccagatggagccccaagtgtacaaattatattccgagctgattgaaagtcatgagagcctggaaaaaagacttgaattattattcttagcaaatgattttctcatccattccaaagccgagatcggttcggcgcatcttttcgaagtaatgaaagaaaaagacatttggcaattcggtgagcttcttcaacatcatgacctaaagcactttacccaagatcttggcgttatgcttgattacttgacagaaaagggacttatcaacgtctgccagatagaaacgaaaggacaggctgtctatcaccgaggatattcttttaaaaaagatgttgactctgattcttgaccgtgttatattattaaacgtcgctgatgcgcttctgagaaaacaagctcacagcggcgggaaaataaatcaaaaaaacatttgacaaaagaaagtcaaaatgttatattaataaagtcgcttcaacaagaagtgaaaatgatctttgaaaactaaacaagacaaaacgtacctgttaattcagtttttaaaaatcgcacagcgatgtgcgtagtcagtcaaactagggtctgcacgacgcaggtcacacaggtgtcgccgcagaaagcggtgaacttaacctgtgatccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaatgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctatacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatgggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccacattttgaatgatgtcacacctgttatctagttttgagagaataagtttttcaaaaaaacacttgattttctcaagaatacatagtataatgttaaatgtcactgaaattgtctggtgatgatggcgaagaggtcacacccgttcccatgccgaacacggaagttaagctcttcagcgccgatggtagtcgggggttccccctgtgagagtaggacatcgccaggcagacttcattccgcagtagctcagtggtagagctatcggctgttaaccgatcggtcgtaggttcgaatcctacctgcggagccattattggagagctgtccgagtggtcgaaggagcacgattggaaatcgtgtaggcggtcaactccgtctcaagggttcgaatcccttgctctccgccactgatacttatacataattacaattgaaagtctgggcccgttggtcaagcggttaagacaccgccctttcacggcggtaacacgggttcgaatcccgtacgggtcattatatgatggaggattagctcagctgggagagcatctgccttacaagcagagggtcggcggttcgagcccgtcatcctccaccattatatcatcgcggggtggagcagttcggtagctcgtcgggctcataacccgaaggtcgcaggttcaaatcctgcccccgcaaccaaattttaaaatggtccggtagttcagttggttagaatgcctgcctgtcacgcaggaggtcgcgggttcgagtcccgtccggaccgccatttaaatacttaggctcggtagctcagttggtagagcaacggactgaaaatccgtgtgtcggcggttcgattccgtcccgagccaccacctatgccggtgtagctcaattggtagagcaactgacttgtaatcagtaggttgggggttcaagtcctcttgccggcactgttttttcaaaatttaatgtggaggggtagcgaagtggctaaacgcggcggactgtaaatccgctccctcagggttcggcagttcgaatctgcccccctccaccatttataggggcatagtttaacggtagaacagaggtctccaaaacctccggtgtgggttcgattcctactgcccctgccaaatttatgacatcttgagattatggcggttgtggcgaagtggttaacgcaccagattgtggctctggcactcgtgggttcgattcccatcaatcgccccatattatcattgggctatagccaagcggtaaggcaacggactttgactccgtcatgcgttggttcgaatccagctagcccagtctcactttttatatcaactgcatataatgtattaagtccattaaaaatgcggaagtagttcagtggtagaacaccaccttgccaaggtgggggtcgcgggttcgaatcccgtcttccgctccaattacggcggcatagccaagtggtaaggcagaggtctgcaaaacctttatccccggttcgaatccgggtgtcgccttcttattgccggggtggtggaattggcagacacacaggacttaaaatcctgcggtaggtgactaccgtgccggttcaagtccggccctcggcaccaattttacttacatggtaagttgaattggtgtttgtgttttatcattataactaatcatattaatgatctacttatgtagatcatttttttaatgctttgatttatcataacaagttaagttccgaggcctattataaagcggctgtatagctagtctttcaacacttttattttatatttccataaaaacttttttgaaatacgttgacactttatgagattcatgatatatttatattcgtcggttagatacgacgtaaaacttgccggtgtggcggaattggcagacgcgcacgactcaaaatcgtgttccttctggagtgtcggttcgaccccgaccaccggtatactgaaaaacccgtttcttaacagaaacgggtttttattttttattaaagaaaaggagccgaggctcctttttatacttactcagcgtattggtctaggatctcttctagcacctcttctagctcttctgtatcttcaagctctgattggctgaaacggacgcgtacaagctgttctccgtcattatacatctcttccagccaccctcggagtcctcttgctctgcggtcgacttcgaaaatgatttccaaaccgtcttcgtctaaaaggaaaatgagctctaattcatcaagcatctgacgataatatccggaagtcggaacgaattcgaattcttgaacaaacggaagacgacgctggaagtatggcgcttgttcgcagtctgcttcgttaagacggaagcccaggttttcgattgcttcaagcacattttcaatccaagggtgcgcttcaacgaaaatacggtcatgatcggatttatcgataccgccttgaatgtcaaggtctgtcaccacggcaacctctactttccctacagtgatcggcgtatctagaggcagagtgaatgtgaacggaaattgatgctcttcaccaggctgtatggtaaatgaaccagtgacccggaaagaatgaattgtagcgtatttccggtgctcttcatcgtcttttacaatgacataccgtgtgctaagctgtaaatcgatataacggatgtcctgagcgatttttccgcctttgacatgtaccgttccctgtacttcttctcctggaaaatatgcgtctttttctaaaattgtatctacttttgcagctccaattccggcacttgccgcaagcttcttaaaaaatgacatgttagatcttcccctttttcttttttctcaacagatatacgtaagaaggaggaaaaaagattcgtttgattcatacttttttcctattattcgtctcggcctagggacagactaagaataatattgaaaataaaggagtggatggaagtgaataaagaaagtttggttgcagatgaattacacagaatgtttttggccggtgagctgcaaatcacagtagaggaggatataaacagtatttccgaaaggctgagaaacggtgatctcagtttagaccgattaagcggtgaagacgcgtttataaaagaaacggtaaacgaggctttaagaagagtggagcaataaaaaagagacggcatctcatctttgagatcccgtctctttttgtggtctttactgcaagataaaagcgtaattgctcacccgagccaccccttttctaacagaagatctgacagttcatcatggagataaacagttgtatctaattgatcatgcaatgctcttctgatgtggggattttcggcttctgttattgcgacagtgtatttgttaatgctggtttttattgttgttaacaaatcaagaatatctttgggacaaagactttgttcaatgggaaaccacctcctttgttttttagcagctcctgataagaaagtatttggctttgtttcttgcttctatacaaaatgctataataagcaacaaattttgttggggggtgtgatgatgaagcagattattgcgatgggaggcgggggtttttcgatggagccggataatttgtccctcgatcaatatatcctcaatcaatcaaaacgagagcagcctcgtatttgttttttgccgacggcgagcggagattcccaaaactatattcagcggttttatcatgcatttcaaacattggattgcgtgccgtctcatttatctttgtttaagccgccatcatcagatttagcttcttttgttatggaaatggacgtgatttatgttggcgggggaaatacgcggaatttacttgtgttatggaaagagtgggggctggaccatattctcagggaagcatggaagaacggtgtggttgtagctggaataagtgccggtgcgatctgctggtttgaagaaggggtgacagatcagccggaccgctgacaagtttgaaaagtttaggttttttgcaagggagcttttgtccccattatgacggggaaaaggatcggagaccggcgctgatatctaacaagttcttatgcagtggctatgcagcggatgatggggctgctctccatttcataaatgatcagctgtttcagactgtgagttcaaggtcgggtgcaaaggcatatcgggtgatgatggctgaacatgaaatagctgaaatcccgttgccggtcaaatatttagggtgaaattggctgaatattatctatattcctctttttttcagattgattttatgataagatgagtgcgaaatcaatagttactgggggtgcccgctttcgggctgagagagaaggtaagcttcttaaccctttggacctgatctggttcgtaccagcgtggggaagtagaggaattgtttttgttattgtcttgctgggcaataatatgtttctttctgactgtaaccgggttcatttatatgaatccggttttttgtgctggttatgggcttgattttgtcctttcaaacgtagagaggggaaggaaaagtaatgcaaaacaattcagtgcagcaagccaacatttccattatgtcaagtttttcaggcagcaagaaggtatacgtggagggttcttcttcggacatccaagtgccgatgagggagattgcattgagtccgacgacgggatcgttcggcgaagaggaaaacgcgcctgtgcgtgtctatgatacaagcggaccgtatacggatcctgaagtaaccattaatattcaagaaggattaaagccgctccgccaaaaatggattacacagcgcggtgacgtggaagagtatgaaggtcgggctataaaaccagaagataacggttataaaaaagcaaatccaaacgtaagctacccaggattaaagcggaaaccgctgagggcgaaggcaggtcaaaatgtcacacaaatgcactatgcaaaaaaggggatcattacacctgagatggaatttatcgccattcgtgagcatgtgtctcctgaattcgtcagagacgaggtagccagcggccgggcgattattccttcaaacattaatcaccctgaaagtgagccaatgattatcggccggaattttcatgtgaagattaatgcgaatatcgggaattcagcggttacgtcatccattgaagaagaagtggaaaaaatgacgtgggccatccgctggggagcggatacgatgatggatctctctaccggaaaagatattcatacgacgcgtgaatggattatccgcaattgccccgtgcctgtgggaactgttccgatttatcaggcgcttgaaaaagtaaacggcgtagcggaggatttaacgtgggagatttatcgtgatacgctaatcgagcaggcagaacagggagtggattattttacgattcacgcgggtgttttgcttaggtatgtaccgctgactgccaaacggacaactggtattgtgtcacgcgggggagcgattatggcgcagtggtgtctggctcatcatcaagaaagctttttatacacacattttgaagaaatatgtgagattatgaaaatgtatgatattgctttctctcttggggatggtttgcgtcccggatcaattgctgatgccaatgacgaagcgcagtttgctgaattagagacgcttggagagctgacgcaaattgcctggaagcatgatgttcaggtgatgattgagggtcctggacatgttccgatgcataaaatcaaagagaacgtcgataaacaaatggacatttgtaaagaagcgcctttttacacattggggccgttgacaacggatattgctccgggatatgaccatattacttcagcgatcggagcggcgatgatcggttggtacgggacagcaatgctttgttatgtaacgccgaaggagcatttagggctgccaaaccgtgatgatgttcgtgaaggagtcattacatataagatcgctgcgcacgctgcggaccttgcaaaagggcatcccggagcgcaaatccgggatgatgcgttatcgaaagcccgttttgaattccgctggcgggatcagtttaatttatctcttgatccggagagagcccttgaataccatgatgaaaccctgcctgctgaaggagcaaaaaccgctcacttttgttccatgtgcggtccgaaattttgcagcatgagaatttcacaggatattcgggattatgcgaagaaaaacgatctcagtgaagcagaagctataaataaaggattaaaagaaaaagcaaaagagtttgtcgatacgggaagcaatttatatcaataaaaaaaatgaagatggagaatgctccatcttcattttttttagaaaaacagagagcgtcgaagcggcggaatactctgttcaaagcggaaaacattttctggatcatatttcgttttgacacggcggagtcgttcaacgttttcgccgtaatatgttcttggccagtttctgatttcgatatctggccaatttacgtagtctcccatcgtttctctcgaaagggacgttctcagcccctcaatccagcggacattttgtcttttttcttcaggagatgtccagtttgttaagtattcctgggcgatgattgcatcacgataataaaatgccgtttggtcgggagcgatccgtccggctgccccgccgagtgcttgctgccagacactggcgttttgattcggagcgtgctctaaaaagtgttttattgttgagatcggacgttctgataatggcttttcaatgaaagagccggagcgtttcattttttgaggctgattgcctcccgggctgttaaaaaaggttaccgcttcgatgaacggcattgtttttaccattccgcttgttgggcttcctgctttcaataaagtctttaacagtttttttaactctgtttttggcccgacaaattggccgagggcttctatgcggtttacttctttaggccaaaactctattgatgatgtaagccggtcatctgtatacggggcccagtgctgccacgtgttaaatacttcctcaaaatcatcccatccccatgtaatagaaaaaatcgacacttgagagatgggcactgctttaaatgtcatggaggtgactatgccgaaattgcctcctccgcctccctgagacgcccaaaataagtctggatgatttgaacagctgactgtaatcagatcagcgccctctttttcgtctgctacgatcatctcaagctgcacgaggctgtcgcaagtaaggccggcagcccttgttaaaagtccaattcccctccgagagttaaacctgtgagccctacattggcaatggtgcctgcgggaagcgtcaggccgtattgccagagtgtccgatagacttctcccaattcagcccccgcttcaatataggccagctttttatcctgattcacagttatttttttcatttcgcttaaatcaataacaagaccgttatttaaaagggaaaagttctcatagctgtgtctgccgcctctaatacggaaaggcacacggttttcacgcgcccatttcagcgcattgagtgcatcctgtttgttttggcaaaacacaatgatgtcaggatacctttctaagcttaggttaatattggttcttgcttcgttatagtccggatcatcccgtgtcacgatacgtccggtcaattttgtcttttccacactcccacatctctttctctcgtattctagtttctctagcttatgcgtcaagggaaaagagtgtataaggaaaaagcggggatgcaatctgatacagtgtcaactcccttaaaaaatagttgacaggtcggtattgtatgaattaacatggtcagtacaaatttttcaaatttatcgcgctgatcggaacaccgaaggctcttatcgtttagataagggccttttttgtatgaaaaaggagggattattgatgggagtcaaaaaagaaaaggggagaaaacgattcagaaagcgaaaaacctacgggaatcagattttgccgcttgagctgctgattgaaaaaaacaaacgagagattataaacagcgcggagctcatggaagaaatttatatgaagattgatgagaagcatacgcaatgtgtaactaaatagaaaaaaacccgctgattacagcgggtttttgcatttctacattaagcatcttttttaatcggcaatccaaggccttctgccacgcgttttccgtattcaggatccgctttgtagaagtgctcgatttggcgcagtttgatttcttctttttctaccggcttcatagcattaacgatattttcaacaaggcgggtacgttcatcttcactcattaaacgatacagatcaccggcttgagtgtagtgatcgttgtgatcgtagcttacgctgtcagcgatgccttgtaccggatatgctgcttgcttatcctcaggtgactcttttggaccgccgaagctgttaggctcgtaatacacagatccgccgccgttatcatcaaagcgcatttgtccatcacgctgataattgtttactttgttgcgtgcgcggttgattggcagcgcttgatggtttgcaccgacacggtagcggtgtgcatcatgataagcaaacagtcggccttgaagcattttatccggtgaaacatcaataccaggcacgagtgttccaggtgaaaatgtcgcttgttctacctctgcaaagtagttttccggatttctgtctagaaccatgcgtccgacctcgattaacgggtagtctttttgagaccaaacttttgtgacatcaaacggatcgaaacggtacgtgtttgcatcttctaaaggcatgatttgcacatatagtttccatgcaggataatcaccgttttcgattgcattgaaaaggtcttctgtatggtaatcagggttttcaccggcaatttttgctgccgtattgacatcaaggtttttcacgccttgttccgttttaaaatgatatttaatccatacgccttcgccttcggcatttgtccatttgaatgtatggcttccgaagccgtgcatgtggcgaagtgttgcaggaattccgcggtcagacatcaggattgtcacttggtgaagtgactctggtgaaagtgaccagaaatcccatacagccgttgggtttttcaggtgtgtttttggatctcttttttgtgtatggatgaaatcagggaacttaatcgcatcgcggataaagaatacaggcgtattgttgccgacgatgtcgtagtttccttcttcagtataaaatttaacagcaaatccgcgcgggtcgcgaactgtgtcagcagagccaagttcaccggcaactgttgagaaacggatgaacaacggtgtgcgtttgccgacttcagaaaggaaagcggctttcgtgtattttgttacgtcgtttgtcacttcaaaatatccgtgtgcgcctgctcctttggcgtgaacaacacgttcaggaacacgttctcggttgaaatgggccaatttttcgagtaaatgtacatcttgaattaaagttggtccgcgagaaccggcagtcattgagttttgattatctccaaccggagcgccccagctagttgtcagtttatttgaactcatgttatcacctcttggaatttataagaacataatatcatctctaagtaaaaagtcaatattattttataattattataaaatagttatctctattaagcgatatctagtattgaaagtgtggaaaaaccttgttggaacagctttttatggcacttgataatttttgaagaaataatttttccttctctatttgcgaaacaagcagagtaagtgataaacaaggatatcaaaaatcgtatttaaaaaagagttgacatatcggaataatttgaattaacatgttattcaaacaaaaaacaattgggcagctgatcggaccgccgaaggctctcatctctacaagaacagagatgggggcctttttgttttttttgaaggcggggttggcagaaagagagggataaaagtggctgtgaccatcagcatcaaagaaaaggcatttgttcaagagggccgcaaaaacacggtcttagagaacatagaattatcaatcgcaccaggcgaatttctaacgcttatcggaccgagcgggtgcggaaaaagcaccctgttaaagattattgcagggcttgattctgaatatgacgggagtgttgaaattaacggccgcagcgtaacagctccgggtattcagcaaggatttatttttcaggaacaccgcctctttccttggctgactgttgagcagaatattgcagccgacttgaatttgaaggacccaaaagtcaaacaaaaggtggatgaactgatcgagattgtcagattgaaaggatcggaaaaagcatatccgcgcgagctgtcaggcggcatgtcacagagagtagccatcgcccgggcccttctgcgggagcctgaggtgctgcttttagatgaaccgtttggtgcactcgacgcttttacaagaaaacacctgcaggacgtgctgctggatatatggaggaggaaaaaaacaacgatgattctcgtgactcatgatatagatgaatctgtttatttaggaaatgagcttgcgatccttaaggccaaaccggggaaaatccataagctgatgcccattcacctggcgtatccgcgaaaccggacgactccggatttccaagcgatcagacagagagtgctgtcggaattcgagaaaacagaagatttggagtacgcagaaggatcagggatatagaaagggcggaagcggaaatgaaaaaaggactcattgtattggttgccgttatttttctgctcgcaggctgtggagcaaatggagccagcggtgaccacaaacaattgaaggaaatacgtattggtattcagcaaagcttaagcccgcttttgatcgcaaaagaaaaaggctggttcgaagatgcatttgaaaaagaaggcatcaaagtgaaatgggtggagtttcaaagcggtccgccccaatttgaaggccttgcggcagacaaacttgatttttctcaagtcggtaattcgcctgtgatcgctggacaggcggcaggcattgactttaaagaaattggcttatctcaggatgggttgaaagcgaacggcatccttgtcaaccaaaacagcggcattcaggacgttaaggacttaaagggaaagaaaattgcagtcgctaaaggcagcagcgggtttgattttttgtataaagcgcttgatcaagtggggttgtcagctaacgatgtgacaattattcagcttcagcctgatgaagcagcttccgcatttgaaaacggatctgttgatgcctggtccatttgggagccgtacttgtccttagaaacaatgaaacacggggcaaaaatccttgtgaacggagaaagcacagatttatattccccgggttttactttagtaagaacaaagttttcagaggagcatccagacgaagtggtccgttttctgaaggtgtttaataaagccgttgtatggcaaaaggaacatctggatgaagcagcggacttgtattctgacattaaagatctcgataaaaaggtcgtcgaaaatgtgctgaaaaatactgaacctctgaatgaggtcatcagtgacgacattgtgaaagcgcagcaggaaacagcagattttcaatttcgaacaaaggcgatagataagaagattgatgtgaaggatgttgtcgataacacttttatcaaaaaagcattaaaggaacattcctcaggaggtgatcaatgatgaaagcagaggctgcgggctcgctgcccaaaacgaatgcggaagcggtgcgaaaaaagcccggaaggaagagatacggctggatgaaggggcttttactgcccgctgtcatcattgccatctggcaggtcatcggcgggctgggggttgtgtccgctacagtgctgcctacacctgttacgattgttctgacctttaaggagcttattttgtccggcgaactgttcggccatctgcaaatcagcatttatcgggcggcacttggttttttgcttggcgcggggcttggattgatgatcgggattttggccggattttccaaacggacggagctgtatcttgatccgtcgttgcaaatgcttagaaccgtacctcatctggccgtcacgccgctgtttattttatggttcggatttgacgaagtatctaaaattttgctgattgcgctcggtgccttctttcctgtctatatcaatacgtttaacggcatccgcggggttgacgcgaagctgtttgaagtcgcccgggtgcttgaatttaaatggcatcagcagatatccaaagtgatattgccggcagccctgcccaatatattgctaggcattcgcttatcgctcggcattgcatggctcgggctcgttgtggcagagttgatgggctcaagctcgggagtcggctatatgatcatggatgcgagacagttttcacaaacgaataaagtctttgcagggattatcatttttgcagtggttggaaagctgacggattccttcgtcaggctgctggaacgaaagctgttaaagtggagaaacagctacgaaggataaaagatataaaggggagatgaatatggaaattctttggtttataccaactcatggagacgcgagatatttaggatctgaaagtgatggacggactgcggatcatctttactttaaacaagtcgcgcaggcggcagacaggctgggatatacaggagttcttctgccaacgggaagatcgtgcgaggacccgtggcttacagcgtcggcactggcaggagaaacaaaggacttaaagtttttagtcgcggtaagacctggtttaatgcagccttctctggcagccagaatgacatccaccctagaccgcatttcagacgggcggctgctgatcaacgttgtggcagggggcgatccgtatgagctggcaggcgatggcctgtttatcagccatgatgagcgctacgaggcaacagacgaatttttaaccgtttggcggagacttttgcagggagaaacggtttcctatgaaggaaagcatataaaagtggaaaacagcaatctgcttttcccgccgcagcaagagccgcatccgcccatctatttcggtggttcgtcacaggctgggattgaagctgccgcaaagcatacagacgtatacttgacatggggggagccgcctgaacaagtaaaagaaaagatagaaagagtcaaaaagcaagcggcaaaagaagggagatccgttcgatttggcattaggctgcatgtcattgcccgtgaaactgaacaagaggcatgggaagcggcagagcgcttgatcagccacttggatgatgacaccattgccaaagcgcaggcagctttgagccgttacgactctacaggccagcagcggatggccgtccttcatcaaggcgatcggacgaagcttgaaatcagtccgaatctgtgggcggggatcggcctagtcagaggaggggcaggaacagctcttgtcggtgatccgcagacgattgccgaccggatagcggagtaccaggcactcggcatagaatcgtttatattctcaggctatccgcatttagaagaagcgtattattttgcagagcttgtatttccgcttttgccgtttgaaaatgatcggacgagaaagcttcagaacaaaaggggagaagcggtaggaaacacttattttgtcaaagagaaaaatgcatgagtttaataaaaatacagcccccaaacatggtatgatattcaaaaaaagggggctttttttctgaaaacattgagaagcgcggcagtcatttgcctcatagctatgctgtcagcatgcggacattcaaaacagatggaaatcaaagcggcggacatatcagaacttgaaaaaaacagaatggatgtcgcagcttcacaggcattcactgccgaagccgtcaatatcggtgaaggtgtttcttcagctgacatgtacatcgaacattatcaaaagggaaagcttgttgagaggtttggaccggctagtgcagattattcagaggaaaaacccgataccatacaatttgtttattttgagaaggaagagggggaaggaaagaataaacataccaccattcattttggcattgtggataaacagggaaatatagcggctgattcatcggtgaaacgtgacgatagcacaacacaggaaatgactcagaatatttcatcgccggaaccgattactttcgagaagcctgctttgatcggcagcagtattagagggactgacgagacaatgcacacctctgaacataaaaaagagctcattaagcatcaagatgcgttactgtattatgtggaattgcatcattagaatgggcggcttcaggccgtctgttttacaaagcggtatgcttgcttttttgaatggtgcatgatacattttaaatagtaacaatttcgatttaaagggaggctatgtgacttggctaaaaaatcaaaagtggcaaaagagttaaaacgccaacagcttgttgagcaatacgctgatattagacgcgagttgaaggaaaaaggagattacgaggcactcagcaagctgccaagagattcagcaccgggaaggcttcacaaccgctgcatggtaacggggcgcccgagagcatatatgaggaagtttaaaatgtccagaatcgctttcagggagctggcccataaaggccagattcccggtgtgaaaaaagcaagctggtaagaaaaaactccggccgattacagcgcgccggagtttttttcgtttttcttgaaagagatgacgtaggaaaggtgctggatgatcatgatgataaacacaataataatagggaaaaacggaatacgcgattgaaaaagcggataaaaaatgagaagaaccgctgcggcaggcagcgagaagtagacagcgatatatgacgcgcgacatgcttttgccgtcatcatctgctctctttcatcctgctcttcaaactcatcaggcagaagaagctgctttctggcagggcggctttttttctgtaagtacaaataaaccgcaaacgccgcaacaaacagaataaagggggtgaggtttaattcaaataccatcccgccgctctttgtgccgaaaaaagatgctatgccttctgaggcttcaaagtatgaaatcagcgcccagcatgcaaggccaaataaaacaaggtgaaaagctgcttttgttttcatgctcatcttagttttcctcctctaaccaaaagacatcctccattttcatggagaaggctttgcagattttcagtgctaacagcagtgagggaacataatcgcctttttcaatcgctgccacagtctgtcttgtgacgccgaccgtttctccgagtttttcctgagaatagccgaagcgtgccctcagctcttttactttatttttcatcatgacgtctgtccccttcacaatctcgattgattatattgtatagtatacttaacattatgtaaatggaacttaacaactttacaaaaagataactttttttcgacaaaatttttatattcccttgacgaaaaataaataaacatgtaatataaaaaaagtcagagcggtactgttgctgacaatcacaaatgcgggtgtagtttagtggtaaaacctcagccttccaagctgatgtcgtgagttcgattctcatcacccgctccatacatacgttattaacgcagtgtttcgtttctcagataaacgaagtattgcgtttttttatgtaaaaaagaacacgacattcgtgttcttttacgtaagccaatgtactgtatgggtgccgccgtgaatttgttcaaacattttcgttaatgatgataagaggttaacagcgctgcttttctcaatcgatggcgggaaaaaaatgatttgcagcatattcttagtctcgtttgaaacgggatagtggttgacgctgtttttgaaatcgccaaaaatgccgttttcatcagagaaaagcagtatgttttctttttctcccaatgagatccggaccggctcatgaagctttccggcatcataaatcataataggcagagaatattttaatgcgaaaaaatcgattgtgtcatgggccgagtctttactttccatgaattgttccttggatatcgggaccagcatgtcctccattggggttgtttctccctcaaatgaagggttaagctgtttaaagagtttctgccattccttgacgaaggattcatcggatataccgccgtccgcatagtcgaaaaacaaggattcttgaaacaggcggagtctgcctttcagcatttgcggtgaggagccgacttcgatattctcataaatgacagcagctgcatgtaagccggccgcacgttcagtaataacagaatcaagtttgatattcactagcattcactccagttacgtgatatcaacctattataaacgctgtatcgttttatcacaaagaaaggaggctgtgcaaaacatgaacgtttatcagctcaaagaagaattaattgaatacgcgaaaagcattggcgtggacaagattggttttacgactgctgatacttttgacagtttaaaagaccgtttgattcttcaagaatcactcggctatctctccggctttgaagagccggatatcgaaaaaagggtgacgccgaagcttcttttgccgaaagcgaaatcaatagtggcaattgctctcgcatatccttccagaatgaaggatgcgccgagaagcacgagaactgagcgcaggggcattttttgcagagcttcctggggaaaagactatcatgatgtgctgagggaaaagcttgatctactggaggattttctaaaaagcaagcatgaggatatcagaacgaagtcaatggttgatacaggtgaattgtctgatcgcgccgttgcggaacgtgccggaattggattcagtgcgaaaaactgtatgatcacaacacccgagtatggctcttatgtgtatttggcggaaatgatcacaaatatcccttttgagcctgatgtgccgattgaagatatgtgcgggtcctgcacgaaatgcttggacgcctgcccaacgggagcactggttaatcccgggcagcttaatgcgcagcgctgcatctcttttctgacccagacaaaaggatttttacctgatgaattccggacaaaaatcggaaaccgcctgtacgggtgcgatacgtgccaaacggtatgccctctcaataaagggaaggattttcatcttcatccggaaatggagcctgatcctgagattgccaaaccgttattgaagccgcttttgaccatcagcaatcgggaatttaaggagaaattcgggcatgtctcaggttcttggcgcgggaaaaaaccgattcagcgaaacgccattctcgcgcttgcgcattttaaggatgcttccgcactgcctgaattgacggaactgatgcacaaggatccgcgtcctgtcatcagggggacagccgcatgggcaatcggaaaaatcggagaccccgcctacgcggaagagcttgaaaaagcgctggaaaaagagaaggatgaagaggcaaagctggaaattgaaaaaggaattgagttgctaaaagcttcaggcatgactaaacaaggcctgtcctgacatacgtatagagcagaaggaaaaaacacttgagatcatccaagtgttttttctctataaaaaagtatggcgggtggggtgagcttgaagtacattttagaacaattagcggaggagcggctgggctttctggttaacgggcatgctatgagacaggagtctcaagtcggagaccttaaagtcatggagcgtaagaaaaagcttctggaaaaacgtaaagttgacatcataaaagcgaaagcaaaggccgtgattaatcatgtgcgggttgaggatgacggaacgacctgcctttcgtataccatccattacgaatacgtgtgtaaggaacaagatgacagcttgtatatagaagagcacatagaggagcgaatggctttcctgtatgatcacattttgattagtgatcaggaaattgcgaaaaagccggctggatttcatgaagggaccagtattattgactattctgaagctgaagaggaaagagaagcgtttggcagggcttttcaatacgatcgtctcggcgctgtccaatatgccgagaaattttggaacaagcgcaatcctgcttataaaaatttcagcgataactgtacaaattttatttctcagtgtcttcatgcaggaggcgcgccgatgcgcggtcatccgaacaggggatcaggctggtggatgaaacaaagctcatggagctacagctggacggtggcgcactctatgaaaatgtatttgtcgaattcaaaggccggactgcgtgcggtgcgggtgaaatcagcggaagaactgatgccgggcgatgtgatttgctatgacttcgaaggagacggccgctttaatcatacaacgattgtcgtggcaaaggacaaaggcaatatgccgcttgtcaacgcccagacctatgacagcaggatgaggtattggtcatatgaggattctacggcatacacgccgtcaatacgatatgccttttttcatatcgttgatgatacgacaaaagagtaattaatgttataatgatgggcggataagaaaaacagaggtgaacattgtggcattacatgtcgttttatatcaaccagaaattcccgctaacacagggaatattgcacgtacttgtgcagcaaccaatacaacgctacacctgattcgtccgctcggcttttcaacggatgataaaatgctgaagcgtgccggactcgattattgggagtttgttaacgttgtgtatcatgattcgttagaagaattgtttgaggcatatgaaaaaggccagtttttctttattacaaaattcggccagcagcctcatacatcatttgattacactgatcttgacgaggattatttcttcgtgttcggaagagaaacaagcggtttgccaaaggatttaattcaaaataatatggaccgctgcctgcgtcttccgatgacagagcatgtcagatcgttaaatctgtccaatactgccgcgattcttgtttatgaagcgctgcgccagcaaaattaccgtgatttaaaatagtgaaaaaacccgctcatcgatgatgggcgggtttttttgcggatgttgaaatgctttgtttcgtttttgggcttaacaacgtaacagtgttatgttacaatgtacccatcaaaggagctggacttatggaagaacaattaatctctaaaaaagaattacttgaaagaacatcgatttcatacggtcagctgtatcgatggaagcggaaaaacttaatacctgaggaatggtttattcgtaaatccacatttacagggcaagagacgttttttccgagagaggagattttaaaacgtatatcaatgattcaaaagatgaaagaaaatttgtctttggatgaaatgagggaaatgctgtcgccgaaaatgaaggatgtcagcatgaccgctgatgaattgcttcataaaggtttggtttcaaggcctgctcttgaagcctattcagaagacggaggaagtccggttttttcatccagcgatttgctttcgctatatgtgcttgagggactgctgcagtctggaaatgtcagccttgcagaagcaaaaatggctgcagaggtattaaagaagcatgataatgaagagattgaaaaacagacggagctgattgtgctccgcaagctcggtgtcacaacttgttttatagcggctgcggcggacagcattttgtttgaatcatccgtaaaggttgtggaacgggtagatttattaaaagcttcagaggaattaaaaacaacatttatgcaggagggccatcgatggatgtagtggaaaagctggtgataaacggatcaggaagttcaaagggaggaacatttcaatctgttgagattaatggcagcgggacagtggccggggacgtggagtgtgacactttttcttttaatggaaacggaaaagctgacggcagcgtcaaagcgaaagcggtaaccatcagcggttcaggaaagatacatggagacgttgaagcagaatctatccggatgaatggcacttgttttattcaaggagaggtatctgcaaaacaattgaaaatcgctggatcatcaacatttggcggcactgtcaaggctgatggcattgacattagcggaaaagctgtcatggaagcagattgtgaaacagaaacctttcaatcagaagggaaatgcaaaatcagcgggcttttaaatgcagaccaggtgatcattaagctttctgcaggggaaagctatgcgcgggagatcggctgccgccatcttcaagtgacctgcagaaaaggaatgctgacattgctcagattgatgccgcagcctgttctaacagcagagctgatcgaaggtgacgtgattgaattgacaaatacaaaggcgaaaaccgtgcgcggaaataaagtgatcatcggcccggattgccagattgaaaccgtcgaatacagcggggactatacctgtgatccaagcgcatcggttgaaacatccacaaagttgtaaggaggatcgtaatggagacaacaaaactgggaaatttaaaattatatggcgctgggcatgccgcaggaggcgcgtatcacaatgtcagcatcaaaggagaaggtgtagttggagaagggttgtctgctgtaggctgccgcatatacggaacgggcctttttctcggaaaagcagagactgagcggctgcgtgtgctcggagaaagtgaatgtaaaggcgatctgacagccggcaaaatcaatatatatgggataatgaaagtcagcggctcacttcaatttgatcgattcaatctgaaaggccagactgaaattggcgggaatatgactggagaatcctgcgatgtgaaagggaagcttagcgtaaaaggtgattgtgaaacagaaatgttccatgtcacaggctgtgttgatgtatcggggttattaaattcgggtgagatcaagctgggattgagccatgatataagccatgtgcaggaaatcggcggaacaacaattacagtgaaaagacgcgcgagtttttttaatcggaagaaagtgaagctgatcgccgatgtcatagaaggcgatcgggtttatttggagaataccgaagcggcagtcgtcaggggaaaagaagtgatcatcgggccgggatgcagtatcggaacaattgagtacgaaaacaaatatgaatgcgatccgcattcacagattaaagaaaaaacaaaactgtaaaacattgttctgttatacaaaaagggtgctctttcaggagcacccttttttattcttttccaggcttgctttcgtatcctgcggtaaaaattgatactaaaaaagtgacaatgacacccatcatgatgattgttttcaccgtctctccccctcttcaatttttccgtgctgtccgagtctggatgattctgtatttttctttattatgaacggtcgcagtctgccttgtcaacgatgtataagtatctttatttttaagaaaccaaagcatgtatcacgagatggcggcatagattgtatcaaagtaccttatttgcatagtgtatcaaacatgatagaggaggtccttatggatatattaaagaaaattgaacagtacagagaggaagagcagcggctgaaatgggaaggaactttcgccgattatttggagattattaaagaaaatccgatggtcgcgcaatctgctcattctcgagtttttaatatgataaaagacagcgggatagaggagattgacgggcgcaagaagtacagtttttttgaccgcgagctgttcgggcttgaagaatctctggagcgtcttgtggaagagtattttcatccggctgccaaacgtctagatgtcagaaagcggattctattgctgatggggcctgtgagcggcggtaaatccacgctggtcacaatgcttaaaaaaggtctcgaagcgtacacgctgacagataatggcgctgtatatgcgattaaaggctgcccgatgcacgaggaccctctacatttaatcccccatcatttacgcgatgacttttacagggaatacggcattagaatagaaggaagtctttctcctttaaatgtcatgaggctggaggaagagtacggaggaagaattgaggatgtgaaggtggagcgtatcttcttttcagaagataagcgtacgggaattggaacattcagtccctctgatccgaaatctcaggatattgccgatttgacggggagtattgatttctcaacaatcgccgagtacggttcagaatcagatccgcgtgcttatcggtttgacggagagctgaataaagcgaaccgcgggatgatggagtttcaggagatgctgaaatgtgatgagaaatttctctggcatttgctttccttgacacaggaagggaattttaaagctgggcggtttgcgttaatttctgctgatgagctgatcgtggctcacacgaatgaaacggagtttcgctcatttatttctaataagaagaatgaagccctgcactcaagaatcatcgtgatgccggttccttataatttaaaagtgtctgaggaagagagaatttatgaaaaaatgattgcagaaagcgatgtggcggatgttcatattgccccgcatacgttgaaggtcgccgcgatgttctcaatccttacccggttaaaagagccgaagcggtcggatattgatctggtcaagaaaatgagactgtatgatggggaaagtgtggaaggatataactctgtcgacgttgaggatatgaaaaaagaatataatgatgaaggcatgagcggaattgatccgcggtacgtgatcaaccggatttcttcaacgattatcagaaaaaatatggaatcgattaattctctcgatgtccttcgctccttaaaagaaggtcttgatcagcacccatcaatttcaagcgaggacagggagcggtatttgaattttatttctgccgcccgcaaggaatatgacgatattgcgaaaaaggaagttcaaaaagcgtttgtttattcatatgaagaatcagcaaaaacacttatggacaattacctcgataacgtagaggcctattgcaataaaaacaagcttcgtgatcctttgacaggagaggaaatgaaccctgacgaaaagctgatgagatccatcgaagagcagatcggcatttcggaaaacgccaaaaaagcgttccgcgaagaaattttaatccgcatctcggcctatgcgagaaaaggcaagcggtttgattacaattcccatgaaagactgcgtgaagctattcagaaaaagctgtttgctgatctgaaggatgtcgttaaaattacgacctcaacaaaaacgccggatgagcagcagctgaaaaaggtaaatgaagtcgtggcccgtttaattgatgagcacggctacaactcgacgagcgccaatgagctgctgaaatatgtcggcagcctgctgaaccgataagcaacgtgacccgtccgaatagggcgggttattttgtcccattttctaaatagtttgtcaattaaacgtgcatatgtgcatatgatgaatataaatcttttcaaaagacttgtttcataatctggcacaagccggaatacgtatgtatcacgaccacaaatggttaaggaggggaattcatgtcccaaaatgacagcggccattttttgatttctgaggaaaactggtccctccatcgcaaaggcttcgatgaccagcaacgccaccagaaaaaagtgcaggaagcgatcaaaaacaatcttccggacctcgtaactgaggaaagcattattatgtctaatggaaaagatgtagtgaagatcccaatccgttcacttgatgagtataaaatccgttataactatgataaaaataaacatgtagggcaaggagacggcgagagccaggttggagatgttgtggcccgggatggatcagacaaaaaacaagggcctggaaaagggcagggtgccggtgatcaggcaggcgaggattattatgaagcggaagtttcattaatggatttagaagaagcgctttttaaagaattagagcttccgaatctccagcaaaaagagcgggacaatatcattcatacagatatcgagtttaatgatatccgtaaaacagggttaaccggtaatattgataagaaaagaacgatgatgtcagcctttaaacgaaacgcaatgtcaggaaaaccgtcgttctacccaatttatccggaggacctgaaatataagacgtggaatgacatcacaaagcccgaatcaaaagccgtcgttttagccatgatggatacaagcggcagtatgggggtttgggaaaaatacatggccagatgcttctttttctggatgacccgttttttgcggacaaaatacgagactgtggaaattgaatttattgcccatcatacagaagcaagagtggtctcggaggaagattttttctcaaagggagaaagcggcggaacaatttgttcttccgtatatcggaagtcgcttgagcttattgatgaaaagtacaatcccgcccgctataacatttacccgtttcatttttctgacggtgacaacctgacatctgataacgcgcgctgtgtgaagctggtcaatgatattatgaagaaggccaatctgttttgctacggcgaggtcaatcagtacaacaggcattcaacgttaatgtctgcatataaaaatgtaaaagatgagaaatttaagtactatattttaaaacagaaatctgatgtttttcaggctctaaagaactttttcagaaatgaagagtctggtgtaagccatcaattttcgtaatgaaaagcccatttcagggcttttttttatttaataaaagcaagaaaacgcttgcgaaaaaaatacgggagaaaaagaaatttttcctttgacaaatcttctttcatttattaatattttatcttgtgaactattattgaggaatgaggtgaaaaggagttgactgaatcagaacgtgctttgctcacttttgaacagctcttcgatacgtctcgggcgatatataaaaaacagaagaagatattggagattgtgcttgagccttttgatattacagtccttcaatatttgctgatgtttaaaattcatcaaagcggaagcaccccgctaagcaagctggcaatgtcgcttgatcttaagcctgcttctgtgacgcggatgacagatattctgtataagcgccaattgatgaatcgatatgacagtccggatgaccgccgtatcgtcatgattcagttaaccgaagagggggaagaactgatagaaaaagccgctgtgcaatatgcaaaaatgggtgctggcttgtaccaaaagcttgatacctcccagctgcagtatttgcgcaaactagccggaagcttaacgaagcttgctgaaggctgttcagaaaaaagcggtaattaaaaacttctcacatattttcaccagctttccgcaaaatgatagaggatgaaacgaaaggagaaaacaaaatgaacagaggacgtttaattctgaccaacattatcggtttgattgttgttcttgcaattatagctggaggtgcttactactattatcaaagcacaaactacgtaaaaacagatgaagcaaaagtagcgggcgatatggctgctattactgctccagcggcaggtaaagtatctgactgggatctggacgaaggaaaaacagtgaaaaaaggcgacacagttgcaaaaatcaaaggcgaacaaactgttgacgtaaaatccattatggatggaacaattgtgaaaaacgaagtgaaaaacggacaaaccgtacaagctggtacaacaattgcacaaacgattgacatggacaacctatacatcacagcaaatattaaagaaacagatattgcggatattgaagtaggaaatagtgtagacgtagtagttgacggagaccctgatacaacatttgacggtactgtagaagaaattggctatgcgactaactcaacttttgatatgcttccatctacaaattcaagcggaaactacacaaaagtaacacaaaaaattcctgtgaaaatttcaatcaaaaacccatctgataaggtgcttcctggaatgaatgcatctgttaaaatttctgagtaaaacagatcagtcatcaaaccatgaaaggaggttgtcttagatggctacaggcaaagaaaaaaatgcaaaaaaccctatgtcattgctgattgtgctaatggcgggtttatttttggcaatcctaaaccaaacactgcttaatgttgcaatgccgcacttaatgactgaatttggcgtaagtgcaacgacgattcagtggcttacaacaggttacatgcttgttaacggtgtattgattccgttatctgctttcctgattacacgatttggccaacggagtctctttctcgtcgcgatgttttgttttacgctcggtacgttagtctgcggtatcgcacctaacttctctacaatgctgatcggccgtttgattcaggccgtgggcggaggtatcttgcagccgctcgttatgacaaccattctgttaattttcccgcctgaaagcagggggaaaggaatggggattttcgggctagcgatgatgtttgctccagcggtcggcccgactctttccgggtggattattgagcattatacatggcgcattatgttttacggtcttgtgccgatcggcgcaattgttatcattgtggctttcttcatctttaaaaatatggtggagccgcaaaaaatcaaactcgatactcttggcgcaatcctatcgattgtcggattcgcctccttattatacggagtcagtgaagccgggtctgacggctggaccgacccgattgtattgtctacagttattatcggagccattgcaattgttgcttttgttgttcagcaattgcgtcatgatgatccgatgcttgatttcagagtgtttaaatatgacattttctcactctcgagtgtcattaatatcattataacagtggcactttacactggtatgttccttttaccgatctatctgcaaaacctggtcggctttacggcgcttcaatccggtctgcttctgcttccgggtgcgatcgttatgctgattatgtcaccgatctcaggtattttgttcgataaattcggaccgagaccgcttgcgattatcgggcttctcgtgacagtggtaacaacatatcaatacacgcaattgacaattgatacaccatatacacacatcatgctgatctattcaattcgtgcatttggtatgtctctcttaatgatgccagtcatgacagccgggatgaaccagcttcctgcccgtctgaacagccacggaacggcgatgagcaacacgcttcgccaaatcagcggatcaatcggaacaagtttaattacgacgatttatacaaaccggacgacattccattattcacaaattgcagataaaacaagcacggcggacccgaacttcctccatgcgttccaaaatgcagtttcgaatttaatggtgaatatgaatgtgtcttatgatacggcgaaaacatatgtgtactcacatatttataaacacgcgtcactcgattccaatgtcatggggataaatgatgcctttatgtgggcaaccttattctgtgtagcaggtttgattttaagtatcttcctgcgtgacgtcagaaaagataaattgcgtaagaagaaaaaagaggagctttcattacttcctgctccaaaagaagctaaggaatcttaatctgtacagggaggtttcctgaatgaaaatttatgtagtgtatgatagtgaaggcgaacatactaaagtgcttgcagaagcgattgctgaaggcgcgagagaaaacgacgcggctgaagtgttcatcgaccatgtagatcaggctgatatccgcaagcttaaagatatggatgcgattatttggggatgcccagggcatttcggaacaatcagctccggtcttaaaacttggatcgacagacttggctacttgtgggctgaaggcgagctgatcaacaaagtcggtgctgtcttctgcacaacggcaacaacacacggcggcttggaaatgacaatgcacaatttaatcacgccgatgttccaccaaggcatgattgttgtcggactgcctggcaacgtgcctgaaaacgcactttatggctcttattacggagcaggtgtcacttgtccggtagacagtgatgagttaatgtctgaggaaggtattcagcttggacgcgcgttgggaagacgtgtcagccaagtcacaggaaacctaacagcaggacagtaaggagaggttgaaatggccattattatagcaataattgctgctgtcattgtcattgcggcccttattacatttaacgtccgcaacgcctcacctggacctgagaagcaagaagcaaccgatagaatcgcacctccagaagagggaaaaaacgaagcgcattaccctgctgaagcaagggctgccgagcatacgccatccgttgtcaaaaacgattctccaaaagagaagcgtgacacaatgggtgatgatatttacaggcaggcgctgcaaaagtttaagcattctgatgaagttcatgcagaagaagaggtcactgaggaaagtgacaaaatgcaggaccgcagctatcgtgatgcgctgctctctatgaaaaataagaaaaagtaatgaaaaaggcaaatccgttttctcatgcgggtttgccttttttgctgtttccatcaattcggtttttatcaaataaatccatggaatatgttgtattccatcttgatctagtgtactatgttactcatacaccgagggttttttctgggaggtaaagacatgaattcttttttaggtttattaaagaaagatatcaagctttcaagaatgtggctgctagtatggatatgcggaatcattttcttattgggaacaggccatattatagcttctcgcacgaaagaacctctagtcatttttggtttttttgttgcagttgctttttttctgcttttcttatctcctgtttttgtgttttatcaccttcgcaaggaagggaaatcacagctttggctgtacaatccaaatggcggcttctggctgttttcttctaaattggcagcatctttgctctatcaatttgtgattcagttggcattaacagcctatggcatatggatgtatcatatgctctctgtaaaaaatctgctggagcatcaagttgatataacgagtacagtggctttgctgaatatgtatgggcttatttcttcgttagatatgtcagtaacagtcattgtgttttggactgtttttcactctctcagaaattggcgcagaatgcggtgggctgcgatggttctgttggttgcagtgtggttattcttcgatgaatacatcataagccctttggttgaatctcaaaagcatttctggcctgtaacagtctattgcaattttgatttccacttctacaatgtttggagattggaattaaaacctatccatctgtctgtgctagggtttcctattactttagtcatcacattcttgctgctcattatggcttcaaaactgcttgatcgtaaagtagaggtgtaaatatggacaatcaattccaatcctcgaaaccgatttatctgcagatcgctgatcagatcttttataggctggtcaggaaggagctgctcccaggagacaagcttccttcagtaagagaaatggcgattcaaactaaggtaaatcccaatacaattcaaagaacttacagtgagatggaaaggctgggtattgtggagacaagaagaggtcaagggacgtttattgcggaaaaagcagaaatcgtagacgagctgaaagacaagctgacacgagaggtgctggaaggctttgtcaagcaaatgaaagagctggggctaacgaaagaggaaatggtagaagggattaaaacattcacagagggaggctaaaatgggaatcaagctagaacatgtatcaaaaaaatacggccgccatacggccgtcaatgatgtgtcaatcaccctatcatccggacggatttatggcctgatcggaccgaacggcagcggcaagtcaacgaccctgaaaatgatggctggccttctgtttccgacttcaggatttgtgaaagttgatgaagagcaggttacgagagaaatggtgcgtcaaacggcttatcttactgagcttgatatgttttatccgcatttcactgttaaagatatggtgaatttttatcagtcgcagtttcctgattttcaaacagaacaggcttataagctattgaatgagatgcagctgaatccggaaaaaaagatcaaaaagctatcaaaaggaaatcggggccggctgaaaatcgttcttgctttagcgagacgggcagacgtcatcttgcttgatgaacctttttccgggcttgatccgatggtcagggattccatcgtaaacagccttgtgtcgtacattgattttgagcagcagattgtcgtgatcgcgacacatgaaattgatgaaattgagactttgttagacgaagtaatcatcctcgccaatggagaaaaagttgcgcagcgtgaagtagaagatattcgtgaacaggaaggcatgtctgttttgcaatggtttaaatcaaaaatggaagtttgctagaaagaggaggaatatgatgaaaacagtgttggaattgaaaaacgtgactaaaaacatcagaggccgaacgatcattgatgatctcagttttacgattcgtgaaggcgaggtattcggttttttgggaccaaacggagcggggaaaacgacaaccatccggatgatggtggggttaatgaagctgtcgaaaggtgatgtcctcatttgcggccaatcaattacgaaagaatatgccaaggcgattaagcatatcggagcgatcgttgagaatcccgagctgtataaatttttgagcggatataaaaatctccagcaatacgcaaggatggtcaagggtgtcacgaaggaaaaaattgatgaagttgttgaactggtcggtttaacagacagaatccacgacaaggtgaaaacatattctctggggatgagacagcgtcttggcttggcacaatgccttctgcacgatccaaaagtgctgattttggatgaaccgacaaacggccttgatccggcggggatcagagaaatcagagatcatttaaagaagctgacccgagaaagaggaatggctgtcatcgtttcaagccacctgctgtcagaaatggaactgatgtgtgatcgaattgcgattctgcaaaaaggaaagctgatcgatattcaaaatgtaaaagatgaaaacattgatgagaacgatacatatttcttccaggttgagcagccgaatgaagccgctgctgttttaaatcagtacgatttgctgagtaagacaaatggtgtagaaatcaaactggctaaagacgaagtccctgcggttattgaattgctggtgatgcagcaaatccgtatttatgaggtcaaggtcataacaaaatcattagaggaccgtttcttagaaatgacaggtgaaacaaaagaggaggttcagcatgcttaatttgatttataatgagtggctcaaaattttcagccgtgccggaacatgggtgatgatcggaattctggggctgacaatggttggatttgcatttttagcgaatcatttttctgctggtgaatcaaattcccattggaaacaagaacttcaagcacaaaacgccgaattaaagaaagaaatcaaagaagatccttcactgaaagatgggtataaagaaacaatcacactcaacgactatcgcatcgagcataatatccctagtgacacgggctatacggtatggtcttatgtaacggattcagcaaactttaccatccttaccggtctgtttactattatcatcgcggccggaattgtcgcgaacgaatttaattggggaacgattaagctattaatgattcggccgctcagccgttttcaaattttgatgtccaaatatattacagttctcctgtttgggctcctgttgctgttgattttatttatcggttctactttattagggttgatcttcttcgggacgggtggtgaaaccgccgcgaatattcatttaatctataaggatggccatgtcattgagcaaaacatgatggggcatttggccacaacgtatctttctgaatccgtctcagccttaatggtggcgacgatggcgtttatgctgtctgcagtattcagaaacagctcacttgcagtagggttttccatctttttattggttgccggtacgactgccactgcatttattgcagcgaagtttgactgggcaaagtatatattgtttgctaatgtcgacttgactcagtatgtggatggcacaccgttaataaaagggatgactatgacgttttctatcgtcatgctggcgatctactttatcatcttcttgttgcttgctttcggaatcttcatgaagcgggatattgcaaactaataaagaaagctgttttgcataagcaaaacagcttttttgtcaaaataaaaactgcaggtttgcacctgcagtttttcatatcaatttatgcttacgcttctttagtaacgttagcagcttgtggtccgcggtttccttcaacgatttcaaaagaaacagcttggccttcttctaaagttttgaagccttcgccttgaatagcagagaaatgaacgaatacatcgtcttgaccttctacttcgatgaatccgaaacctttttcagagttgaaccattttactttaccttctaacatgaaatttcctcctaaagcgatcataacgcttaaattcactattcttgctcttaacaaactttcaagacgaaaactcttacaaaactttcttcttaaagatagttcgaacaaaaataattacctttactctaccagtaatcttcagaaaaaacaactgcttattgaaacttttttcggaaaataccatatttatttttcaatttgatatttatttgcggaaattcatctgctttctcgatatgtgatcatacgtttgccttagtattccttcattttgggaagataagtaataggaattgacaaccttattggatatgagtaaggtaaaagttaatcaatattacaaatgacaacgtttatcaactaagagagcgtatgatttttatgtctgatattgcttgcatgctctaatacatagataggagtatggtcacaatgaaaaagtggcttatatgcagtttcgtccttgttcttctcgtttcatttactgcatgttcaccgtctgcagaacatgaatcgataaaaatcgggattgctgagtctgacggggcaatatggaactatattgctcaaaaggctgaagaggcagggctggatattcagctgatccctttttctgattatgcggagtctgatatcgcacttgctaacaaagaaattgatgccaacgcctttcaaaccatttcatattttcagtcgttcacccaaaaatacaaacttaatttgacgccgctcgggacgacatacataacgcccatgggcatttattcaaaacgatatgaccgaatccaagatataccgcgaggagctgtcgtttctgttccggataaagcgttcgattttggcagggcgcttacagtgctccaggaagcgggtttgctaacgctgaaaaacggatttaacggaacaggttcagttgatatgattaaagataatccgagacacctgaaattaaaagctgtccggcaacaggatgcagtgagcggtgccgacgtgtttgtcatgaaaccatcagaagcaaaaaaagcgggcctgaacccgaaaaagcatacgctaaagagcggcggactcatgtctgaggaagagatgaatttgattgttgtcagagcggaggatcaagatcgggaagcgctgcaaaccattcttgagctttatcaagcagatgatacagcggcatttatagaaaaagaatatcagagagatcttgtcccggcttttctgcctttgaaacgtctttcagattggaagaatgaattcgaacattgaattcattcttttttttctgaaaaacacactctgttccgtcccgtttctttcgctttgtaaagcatttgatcggcaagaatgggcaaggatcctggctgttccgtattattggggtaatgagcggcccctagtgatatcgtaactgaaagctcttcgccgtttgttaatacaatcggtgcatcacttacagtgctcctgatccgttcagcgatccgggctgctttatcaagagaacagttcggcaggagaacggcaaattcttcaccgccgatccgagcggcaggatcagtatttcggatgctctgcttcagacgtaaccccagctctttgagcacctgatctccttcatgatggccatattggtcattgatggtcttaaaatgatcgatatccatataaatcagtgcaaattgaaaatgcggggtatcggccgcctgctgatacagagcttttgtggtttcttcaaactttcttcggttatacacgcctgttaaaaagtcaaagtgcgcctgaaacttatattgtttaaaaagaagatgtgcatttgtttcatgatcaataatatataaactgagcatgccgcccgctattgatatgatccaaaaatacaaatgaagttcgtatgaatgtaaatctataagaaaataaaaggaaaaggagatcaagctatttgtgattattaaaagatagaaagcatgttttagttgaactttttttcttctagaaacaatgagtgacgggatggcagcgatacaaatgataataaccgagtatagtgcagatgtgttcattgtaatcagcaagcggcctgcagtgatcatggccagggccgttgccgttgaaacccagcctccataaagagcggcaatcataatagggatatttcgaagatcaataattgaatgctgataggtaaatccaaaaaccatcagaataaccccgagcaaaccgcaggccagtcctttaacagcttgaaaggatatgctgtcttttttatgtactagcctttctttaaacaggtgggtgaagagataattaaatgtgattaaaatggtcaaatttacaaacagttctttcagcaaatattatcacccttatataaggtactaaagatggaagggaaagaaaagaaaaaaaaaggcattatataaggtttttttacttgaattgataagttaaaataattctcacttgacccatcggaattagtgtaatatagtaaatgagaaaatttgaagggagagtttacctgctttggagactttactggttgtattacatgtatttattttatttttacttatcttagggctctttgttatgcagaaaaaacatgtttccttctctaaacgtgtatttactgcgctggggctgggaattgtattcggatttgcgcttcagctgatttacggcccgacttcaaatatagtcattcaaacagccgactggtttaatattgccgggggcggatatgtcaaattgcttcagatggttgtcatgccgctcgtctttatttcgattctcggcgcatttacaaagctgaagctgacaaaaaatcttgggaaaatcagcggtttgattatcgggattttagtagcaacaacagccgttgctgcagctgtcggtatcgcgtccgcgctttcatttgatctgcaggcgattcaggttgaccaaggaagtacagagctttcacgggggcaggagcttcagcagaaatcagaggatatgacagcgaaaacgctgccgcagcagattgttgaactgctgcctggaaacccgtttttagatttcacgggagctagaccgacttcaacaatcgctgtcgttatttttgccgctttccttggagtggcattcctcggcgtcaaacacaaacagccggaacaggcagaaacatttaaaaaactggttgatgccgtttatgccattgtcatgcgtgttgtcacactcattttgagactgacgccttatggggtgctggcaatcatgacaaaaacaattgccacgagtgatcttgacagcattttaaaactgggcatgttcgtgattgcttcatatgccgcgttaatcactatgtttatcattcatttgctgctgctgacgttcagcggcttgaatccgctgatttatttgaaaaaagcggtgcctgtacttgtatttgcatttacgtcaaggtctagcgcgggtgctttaccgctgaatattaaaacacagagaagcatgggtgtaccagaagggatcgcaaactttgccggttcgttcggtctttcgatcggccaaaatggatgtgccggcatttatcctgcgatgctggcgatgatgattgctccgactgtcggccaaaatccatttgacccggtgtttattatcactgttatcgcagtcgttgccatcagctccttcggggttgccggagtcggcggcggagcgacattcgcggcgcttcttgttttatcatcattaaacatgcctgtcgcgctcgccggtttgttaatctcaattgaaccgttaatcgacatggggcgtactgctttgaatgtcagcggaagcatgacatccggtcttattacaagtaaggtcacaaaagaaattgatcaaggggcatttcatgatcaatccagagtgattgaagctgaagaagcgtaacatatgaaaacgtgtaatccaagaggattacacgtttttttaacggccgggttctaaatcctccagcatttccatcatcgtgttgtcgtccatgacattcattgcgctttgttcaaaatgaatgggttcagcataatgcggctgtctttttttcgcggctgactcagtttgcctagtttgagactgtgtatgctgatgcagtggttgctgctgtccagcgtgctggtgctgacggccattttgccgctggctttgatgctgcgaacggtcctggttatcaccgctgcttccgctgcttccgctaaatgcttgtttgaccatgtttcctacattagaagcatcaaacgtgttattttctgaatttcgtctgttcatttgtcctgtgataaacccgctaattctttggcggatctgaggtgataatgcagcaataagcatagttgatcctatgatcaatgctgcggggctgattcctcttcgctggttgaacaacatgatccctcctttgcagtgtattcatattttccccctcgttagacaaattaaccgttatatttcccgggaaagcatttcctccagatttgcatgcataattaaagccagttagaaaaacctataagtaaagtgataaaggaggaattcacatgtttggaaaaaaacaagtccttgcgtctgtgcttcttatccctttgcttatgactggctgcggtgtggccgaccaaggtgagggcagacgtgataataatgatgtaagaaacgtaaattatcgaaatccggccaatgacgatatgcggaatgtaaacaatcgggataacgttgacaacaatgttaatgataatgtcaataacaatcgtgtaaatgacgataataacaacgaccgaaaacttgaggttgctgatgaagcagctgataaagtaacagacctaaaagaagtaaagcatgccgatatcattgtggctggaaatcaagcctacgttgcagtcgttttaaccaatggaaataaaggtgcagtagaaaacaatctgaagaaaaaaatagccaaaaaggtaagatctactgacaaaaacattgataatgtttacgtttcagctaatcctgattttgtagagcgtatgcaaggatatggaaaacgtattcaaaatggtgacccaatcgccggattatttgatgaatttacacaaactgtacagcgcgtattccctaacgctgaataaataaaaaaagccgcacaatttgtgcggctttttctttgcgttaatgacacactgcgaactcaggctgcatagagtaaaaataaaaaggtacaagacggaccggctcagggagggagacgtttgcgggatggcataggaaagcgtgcggcatccgctctattcctgtgcggagtccttgtgatgctggctgtaagctcagccatcgtatcaagcgcgatgtatatcctgtcttttccaggtcaggcatctggaataacaaaagaacaagtgacgaagcacatgaagaaagagtcattcaaacaggccgatatttattacacttctaaggaaaagtccttactgccattgacgaaagaaacgcttgaatatgcggtcagtattaatcagattatgattggatattcgaatcaaaagcctattgacattattttttttcctaatgaaaaacagatggaggcttactccggtttattggatgtagttggtttttattctgagcgggagcagttgattggactgttgcctgaagagaaaaagaaactgttagaaggggacgaggtagcggtttatttgtaccagagattgttgattcatgaatactcgcaccatgcgtttcatcagaaattgaaggagcttgagacggatcccgatgagtttccgttatggtttcatgaagggttaagcgagtggattgcgaactatgaattgctcatagatccgatcacgttttctgtcgtgccctttgaccgtttgcagactgatcgagactggcaggaagccagagccgaatatgacactgatgtctatttgcaaagcttttatatgatcgatgagctgaccggcaaatacgggaaagacattatttcagaaatgattaaggaaacagcaaaaaaaggggactttgaaaaagggtttaaatcagcaacaaaggaaagtcttgatcattttgaaaaggattttaagaagaaatttgaaaaaaacagtgcggcattggatagtatctatccaatgcctttgttattagtgaagtccttgctgacccattccgccttgtgtcggaggcatttgtccttgggcaggggcgaatgaatttctcagctgttccatatcctgcgcatcaagctgaggaacctggtaatagccgtgtttgttttggtatagaaaaatttcaaatgccatttcaacatactcctgaatttgcgcagacagtacgcgtcttacggccggatttgtcatttccagagacgccatcgtcagcatagaagcttgtgctttaatcgcgcaaagcatttgtcggctgatgatgctgtcatcaatatcattcatggattgaacaggttttttaggctgtgacggctgcatgccgtaaacagcctggttgtcctccttcatcatataagttgctgttttttgtgaaggttcgcttcctgttttgaagcattctgcagttatattgtattgagatgtaatgaattgatgttgacgatcaaggatgtttagtaattcttgatccttacagaattgtctcagcatcatatactgatcaagcacagtaagtgttccggaaagcacctcatgcatatcaaacatttcatgtccgccgtggtttttatgcggtttgccaggaatacctttgttcatttgggattgctgctgctgattgaactgatccaaaccgaattcctccttttttttcagatcaactgtattttgtgtcagtctgccgtgtattatgcagaagcctgaaaggaattatatgctgtctgtcgaaatgataagcagacaaaatcgttgtcattatgtgtatattaagggaggaaatatgatgaggcgtattctgcatattgtgttgatcacggcattgatgttcttaaatgtaatgtacacgttcgaagctgtaaaggcagctgaaccgcaacagcctatatcgattgagaaggcaatacagcaaaaagaaggacaggcgcttgtcgaaggatatgcagtcggccaggctgtttccccgcagcattataagctgacaagccctttctcaaatgattataatgtcgcgctggcagaccgtaaaaatgagacatcgcccgaacacatccttcctgtgcaaatcccctccgccttcagaagccaatttgggctgcaaaccaatccgcttcttcttgggaaaaagataacggttcaaggaaagcttgaaaattactttaacacgacaggacttaaaaacgttcagtcgatgaacgtaaccgatgacacgaaaactccgccggctgaacagccagtgaccataaatgaagcacggggaaggctgaatgaagaagtaacgataaaagggatcattacagctgatcaaaacgcaatcggaggcgggaagctgtcgacctttttgcaagatgaaaccggaggcattaacatttattcgccatcccctgaacaatttcccgaattaaaagagggtatggatgtcacggtgacagggaaaatcacgtcttaccaggggctgaaagaaatcgttccaagctcatcaggcatcaaaatcaaccagtcaaatcaatccctccccgccccaaacacttaacaatcaatgaacttattaacggcagcctaggtgatcagtatgaaggacgccttgtgaaactaactgcttttgtttccttaattccaagttctcctgccggcggcggttacaatgtaacaatgattgatgacgaccatcatgcaatgacgctccgggttatgaatgaaacaggggtgataaacgagcttgatgagggcaaatggtatgaatttaccggtgtgttaagcagataccaaacctttcaactgcttccgcgaaaatcggctgacctgaagctgcttgaagagcagcccgcacctccgtctgcggagggagaatatgaagggattgttgaccgggttgttgacggcgataccattcatctcaaatctccggtgcttggaacgacaaaaatccggtttgtaaatgtagatacacctgaaacatatcacacaccaaaaaatgacgcagatgaaaatcaattaagatttggcaaaaaagcatctgactatctaaaaacggttctgtccccaggtgataaaattactgtcaaggtcgggagtgaagccaaggacagctatggcagactgctcggacaagtcataaccgaatcaggatcaaacgtgaacttagagcttgtaaaaaacggctatgctccgacgtattttatttggccggttgacaatgaagaggattatcagcaatttcaggccgcagtagccgctgcaaaaaaagatcaaaaaggaatttggaatgaaaacgatcccctcatggaaatgccgtttgaattcagagccagagagcaagggaaaggcctgacaagatatgtggggactcgtcgaataaaacatatgtgcagccagctgactggaagaagatagctgtggaaaacagaattttcttcgcttcagcaagtgaagcggagagcgcgggatataaaaaaaggcaaacggcacctcaagaacatgtgccgcttagaattctcagcatgaatgatttgcatggcaaaatcgatcagcaatacgagcttgatcttgatggaaatggaattgcagacggcacgtttggacgcatggattatgccgccgcatatttaaaagaaaaaaaggctgaaaagaaaaactcgctgattgtgcacgcgggagatatgatcggcggaagttctccagtttcctctcttcttcaggatgaaccgactgtagaactgatggaggacatcggatttgatgtcggaaccgtgggaaaccacgaatttgatgaaggcacggatgaactgctgaggatcttaaacggcggtgatcatccgaaaggcacaagcggatataatggacagaactttccccttgtatgtgccaattgtaaaatgaaatcaactggagagccctttttgccggcttatgacatcataaatgtggagggcgtacccgttgcttttatcggggttgtcacacagtcggcagctggcatggttatgcctgaaggaataaaaaatatcgagtttacagatgaagcaacagcggtgaataaggcggccaaagagctgaggaaaaaaggcgtgaaggctatcgcggttctcgcacatatgtcagctgaacaaaacggcaacgccattaccggtgagtctgctgatcttgcaaacaaaacagattctgaaattgacgtgatttttgccgcgcataatcatcaggttgttaacggtgaagtgaatggaaaactgattgttcaagcgtttgaatatggaaaagcgataggtgtcgttgatgtagagatcgataaaacgacaaaagacattgtcaaaaagtccgcggaaatcgtatatgttgatcaaagtaaaatcgaaccggatgtcagcgcgtcagccattttaaagaaatacgaaacaattgcggaaccgattatcagcgaggtagtcggcgaagccgctgttgatatgggaggggggtattcaaatgacggcgatacacctcttggaaacctgattgcggatggtatgagagctgccatgaaaacggattttgctcttatgaatggcggcggcatacgtgaagcgctgaagaagggcccgattacgtggggagatctttacaatattcagccgtttggaaatgtgttaacgaagcttgagattaaaggaaaagatttaagagagattatcaatgctcaaatctcgccggtttttgggcctgactacagcatcagcgggtttacgtatacgtgggataaagaaaccggaaaagcagttgatatgaaaatggcagatggcaccgagatccagcccgatgccacatatacattgaccgtcaacaactttatggcgacggcgacaggagccaaatatcagccaatcggactgctgggaaaaaatccggtgacagggcctgaggatttggaagcgacagttgagtacgtgaagagttttgatgagccaattgcgtatacaaaagagggaagaattaagctcgctgaagccagtgatattgaagaccctgtaacagaagacccgattacggaagagcctggagatgatccggggacggagcatccaatgaaagaggttccagagcctgatgtggatttgcctgatataaaagaaactccgggaacagcaccggttcatcagcttccgccttcagccatttcgagattcaatgaaataccaatcaacaacacaaaaaccgctgatactgctaatagcatcagcacattgccgttacaaaccgagactgcggaaagcgggtctgatcatcagcttccggatacgtcagcgggctactataactttatggtaatcggtgcggcggtgacattgtcaggaacttatctatatgtcagaagaaaaaggagcgcctccagaacgtgaaaaaagttattccactattcatcattgctgccggcctagtgatcgcaggctatggaggctttaaattaatcgatacgaatatgaaaacggaacagacattaaaagaagcaaaactggcggctgaaaagccacaggaacttttggggacgaaaaatagcacagatcaagcaaagaacaaagcatcatttaagcctgagaccggccaagcgagcggcattttggaaataccgaaaatcaatgcagagcttccgatcgtggagggcaccgatgctgatgatttagaaaaaggtgtcgggcattacaaggacagctattatcctgatgaaaacggacaaattgtgctgtcggggcatcgggataccgtgtttcgccggacgggagagctggaaaagggggatcggctccgcattctcctgtcatatggagaattcacatatgaaattgtaaatacaaaaattgtcgataaggatgacacatctattatcacgctccagcatgaaaaggaagagctgattctgacgacctgctatccgttttcatacgtcggaaatgccccgaaacgctatattatatatggaaaacgagtgacttaaaaagccgaggcagtgcctgcggcttttcttcatgaaaaatatgtgcggcaaaggtttttcatatcagcagggaaaggggcttcagcaactatgagctcgtctgttatcgggtgaaccgcttgtactttattggcgtgcagtgcctgcctgtttagcagcttgctcccgcctccgtaaagcgagtctcctgtcaacggatggccgaggctcgccagatgaacacggatttggtgtgttctgcctgtttccagctctaattcaacgagcgacagccgttctttcgcattgctggccattaccttgaaatgagtgacggcagtttgcccgcctggtgaaacccggcgtcttgtcgggtgtgaccggtctctgccgattggtgaattaattgtcccttttttcgtccgtagcttaccttcagcgatggcggtatacgtacgcttcagcgtctttttctctaactgctggtctaagatggcgtgtgccaaacgatgcttggcaaaaacgatagcgccagatgtatcctgatcaagacgatggacgtggcgcaccttacatgtttcgccatttatctgataatgataagcgatcaaattagccagtgtgccggtttgcccatcctcattcggatgcgtcgcgatgccagcgggtttattgacgatgagcatatgattgtcctcatataaaatatcaagctcgccatactccggaatgaccgaagatgcttcactttcctgaagatcaatgaacacacggtctcccttttttacaatcatattgtttaagacggattcgtgattgacctttatctgttgatgggacatccagtcttgtatcactggtttagaagctttgagcgctgttttgagtacggaaaacagccattggccgtcctgtttttcattgatgaggatctcaagccctctgcctttttggttcatgttaaatggctccttttcgaagcggaaggctgctgtttctcataggaaacacttaccttagctttcgcgtttttttctgtgctattcttgagtaagacttaggatattcgatggcaagaaaggtgattgacgtgagaattgtgaacgcagcaactgcagaacaggagagctttatcaaggagctgtctatggagctgatccatgatgtatttcctctttatttctccgaactggacattcagcgctttaaaaagaaaggcgttctgtctttaaataaccattattaccaaggaacattaaaagaagcatttcaaattatggcttgtcttcaaatgatacatattatcctgaccaagccttcgccgcactctgatttgagtgatcaggcgatttttgaaaaaaacagcaagatgctgaatgattttgggatttattttccgtttgctttttctgactttcaaaagaagactaacaaagcctttttcggtcaaagaaggctgatataatcatgcggcaagggcttttctatttttagaaaagctcttttttgtatcagagaaatcatatcataaaacctttcctctaactccctttttaaacggctcgtgtctgaacatactaatgattgaaaggggtgctgacaatgagttcagttaaagatacaatgacaacgcaggtggcaaccgtttctccgaatcaaacgattcaggaagcggcttctctaatgaaacagcataacgtcggggcgatccccgttgtagagcaaggtgttttaaaaggaatgctgactgaccgtgacattgcattaagaactacagctcagggccgtgatggccagacacccgtttcagaagtgatgtcaacagaactcgtatcaggaaaccctaatatgagtctggaagacgcgtcgcagctgatggcccagcaccaaatccgccgccttcctattgtagatcaaaacaatctagtcgggatcgttgcgcttggagacctggcagtcaatcagatgtcgaacgagtctgcgggatcagcgctgacaaacatttctcaccaaaacattcattaataagaaagagcttgcagtgtgcaggctctttcttcacataaaaccttactttttgaaagcagacttgtttcggggtatagtgagtgtatacatatgtctcaattcgtactaaaggagttgtacccagtgattaaagcgttaatttttgattttgacgggcttattctagatacagaaacacacgaatatgaagttcttcaggaaatatttgaagagcacggctcagtgctgccgctatctgtctgggggaaggtcatcggaactgcagcgggtttccggccttttgactatttagaagagcagatcgggaaaaagctgaaccatgaagagctcacacaattgagaagagagcggtttgccaaacgcatggaatcagaaaaagcgagacctggtgtcgaagcgtatttgaatgcggcaaaggatttaggcttaaaaataggccttgcctccagctctgattataaatgggtgtccggccatttgaagcaaatcggcctgtttgatgattttgaagttattcaaacggctgatgatgtggaagaggtgaagccgaatcctgaactctatttattggcggcaaagaacctgggggtatcgccagcggaatgtctcgcgtttgaggattctgtcaatggttcgattgctgcgaaacgtgcaggcatgaagtgtgtcattgtcccgaataaagtaacgggcaccttgatgtttgaagactatgatcacaggcttgaatcaatggcggagatggagctcgccctattgcttgatcatctgaactcacaaaactagaaaggagcgagtaggttgtctgagaaattagatttgacccggtttgaaaagaaaatggttatccgcaatatcgaagagaaagacatcgacaagattatcgatcttcaaaaggactgctttccaggaatggagccttggaagcgggagcatttaatcagccatttggagcattttccagaagggcagttttgtgcagaattcgaaggtgaaattatcggttcgtgctcaagtctcctgattaactttgatgaatatgatgaccgtcatacatggcaggacattacagatgacggttatatcaccaaccataatcctgacggcttgaatatgtatggaattgaagtcatggtggacccgaagtacagacgaatgaagattggccaccgtttgtacgaggcgagaaaggacttagccagacgcttaaacctgaaaagcatcatcataggcggacggattccaaactatcacaaatatgcagaggaaatgacagcgagagagtatgttgaacaggtgacacgccaccaaatttacgatccggttctttcttttcagctgatgaacggctttacccttatgcgaattaacccgaactatctcccggatgatacagcttcgatcaagtatgcgacgctgatggaatggaataatgtggattatctaccgcagcagacaaaacgctattataaatcggcgttccctgttagaatttgtgtgattcaatacgaaatgaagaaaatttattcctttgaggaatttgcgaatcaagtagaatactatgtcgatgttgcttccgacgcaagatctgattttgcggtgttcccggaaattttcacaacccagctgatgtccttccttgaggaacggtcaccgagcttggcggtgcagagaattactgagtatacagaagattacatcagcctgtttactgacttggctgtgaagtataacgtcaacattatcggcggatctcatttcgtcgaagaggaaggcaagatctataatatcgcttacctgttcagacgggacggaacgatcgagaagcaatacaaactccatattacgccgaatgaacgcaaatggtgggggatcagcgcaggagaccaagttcgcgtgtttgatacggactgcgggaaaatcgcgatccagatctgttatgacattgaatttcctgagcttgcccggattgcggctgataaaggagccaaaatcatctttacgccattttgtacagaagaccgtcaaggctatctacgtgtcagatactgttcgcaggctagagcggttgaaaatcaaatttatacggttatctctggaacggtcggaaaccttccgcaaacggaaaacatggatatccaatacgcccagtcaggcatctttgccccgtctgattttgaattcgctcgtgacggcattgtcggcgaaacaaacccgaatattgaaatggtcgtcatcggcgatgttgacctggaaattctcagaagacagcgccaaaacggtacagtgcgccagctaaaagacagacggcgtgatatttatcatattcaatataaaaaataattcccaaaaaacccgcctgaattggcgggttttttaaaacaaaagcggaattgtttaggtgctatctttaaaataaaagtaggtataatggagtttctgtattttcgccatttcctatatcatacagaaatcggctaggcttccattgctattgcaatggctgtccaagttgtttcgagtgcgacctttatcagtacgatgctgagcattgccactttgcctgttttgctttggaagctgcatcctctttcttcttgagaaagaggatattttattatttacgcggtttattgactctgacccggtctggctttatattgaaggcagggaaatcatcaccaagacatcacataaagagaaggtctgtttcaattgaattggcattatagagaacgctaatgaaatggagatgatggggatggaaaacattcagcaaaataagggattaaagcaaaaagatgagcaatttgtgtggcatgccatgaagggagtgcatcaagcggacagcctgatagcccagaaggccgagggggcctgggtaaccgacacagacggacgccgctatttggatgcgatgtccggtttgtggtgcgtcaacattggttacggcagaaaggagcttgcggaggctgcctatgagcaactaaaggagctgccttactacccgttaacgcaaagtcacgcacccgcaattcaactggcggaaaagctgaatgaatggcttggcggcgattatgttatttttttttccaacagcggatcggaagcaaacgaaactgcttttaaaattgcccgccagtaccatctgcaaaacggcgaccacagccgttataaattcatctcaagatatcgggcataccacggcaatacattgggagcgctctcagctaccggacaggcgcagcggaaatataaatacgagcctttgagccaagggttcctgcatgcagctccgccagatatataccggaatcctgatgatgcagacacgcttgaaagcgcaaatgaaatcgaccgcatcatgacatgggaattaagcgaaacgattgccggggtcattatggagcccatcattacaggcggaggcatcctaatgccgccggacggatatatgaagaaggtggaggacatttgccggcgccacggagcccttttgatttgcgatgaagtgatctgcgggtttggacggacaggtgagccgttcgggtttatgcactacggtgtgaagcctgatatcattacgatggcaaagggaatcacaagcgcgtatctgccattgtcagcgactgctgtgaaacgggacattttcgaagcgtatcagggggaagctccttatgaccgtttccgccacgtgaacacgttcggcggaagcccggctgcctgtgctttggcgttgaaaaacctgcaaattatggaggacgaacagctgattcagcgatcccgtgatcttggagcaaagcttttaggtgagcttcaagctctgagagaacacccggcagtcggggatgttagaggaaaagggctgctgatcggaatcgaactcgtcaaagacaaattgactaaagagccggctgatgccgccaaagtaaaccaagtggttgcggcgtgcaaagaaaaagggctgatcatcggcaaaaacggcgatacagtcgccggctacaacaatgtcatccagcttgcgccgccattttgcctgacagaagaggacctttcctttatcgtgaaaacggtgaaagaaagctttcaaacgatataatataaaagtgaattattaaaggagcacatgatgagttttcacaaccagccgatcttaccggctattcgcaatatgaagcaatttgatgagtttttgaacagttcattctcttacggtgttattcttgatattcatctcggccagctgaagggcgtgatcaaagaagcgcaaaagcacggaaagaacatgatggtgcacgtcgatctcattcaagggattaagcatgacgaatacggtgcggaatttatatgtcaggatatcaagcccgctgggattatttccacaagatcgaatgtgattgccaaagcgaagcagaagaaaatttatgccattcagcgcctgtttttgcttgatacaagcgcgatggagaaaagcatggagtttatcggcaagcataagcctgacttcatcgaagtgcttcccggcatcgttccgtcactcattcaggaaataaaagagaaaacagggattcccatctttgccgggggtttcatccgtacggaagaggatgtagagcaggcattgaaagcgggggctgtagctgtcacaacatctaataccaaattgtggaaaaaatatgaaaactttttgacggaaagtgattgacaccgctttcatgcactgatacaattgcactaggttaatacattgtgatggagaactcggagaccacagcagctctttacggcaaatgtttatgcacccgtaaagcggtttgttgtggtttttttattctcttcttctctatcatgctttttaatcgtgactttaggaggaatgtgctatgacagcattttggggagaagtcatcggtacgatgctgcttatcatttttggtgcaggtgtttgtgcaggtgtcaatttaaagaaatcgctttcattccagtctggctggattgttgttgtatttggatggggattgggtgttgccatggcggcatacgcggttggcggcatcagcggtgcccatttgaatccggcgctaacgatagcgcttgcatttgtaggagattttccttggaaagaggttccggtttatattgcggcgcaaatgatcggagcgatcatcggtgcggtgattatttatctgcattacctcccgcactggaagtcaacggatgatcccgctgccaagctgggtgttttctcaacagggcccagcattccgcatacatttgcaaacgttttaagcgaagtgattgggacatttgtccttgtacttggaatcttggccattggggcaaatcaatttacagaaggacttaatcctttaatcgtcggtttcctcattgtagcaatcggtatttctctgggaggaaccaccggctatgctatcaatcctgcacgtgacttaggtccgcggatagcccacgcttttcttccgattccggggaagggctcatcaaactggaaatacgcatgggttccggtagtcggcccgattttaggcggatcattcggcggcgtattttacaacgctgcatttaaagggcacatcacaagcagcttctggattgtaagcgttatattggttgtggtattgttaggactctatgtttatacgaaatcacattctgctaaaacattatcaaattcaaaatatatttaatcaaaggggagacatcttatggaaacgtacattttatccttagatcaggggacgacaagttcaagagcgattctgtttaataaagaaggcaaaatcgttcactctgctcaaaaggaatttacacaatacttcccgcatcctggctgggttgagcataatgccaatgaaatttggggctctgtcctcgcggttatcgcctcagtcatctctgaatcaggaatcagcgcttctcaaattgccggcatcggcatcacgaaccagcgcgagacgacggttgtgtgggataaagatacaggaagtcctgtctataatgcaatcgtttggcagtccagacagacgtccggcatttgtgaggaacttcgtgaaaaaggatataatgataaattcagagaaaaaactgggcttttaatcgatccatacttctccggcacgaaggtgaagtggattttagacaatgtggaaggcgcaagagaaaaagcggaaaaaggcgagctgctgtttggaacgattgatacgtggctcatttggaaaatgtcaggcggaaaagcgcatgtgaccgattactccaatgcctcaagaacactgatgtttaatatttacgatttaaaatgggacgatgaactgctcgacattctaggcgtaccgaaatccatgctccctgaagtgaagccgtcctctcatgtgtatgcggagactgttgattatcacttcttcggaaaaaatatcccgattgctggagcggcaggcgaccagcagtccgcattgttcggccaggcatgctttgaagaaggcatggggaaaaacacatacggcacaggatgtttcatgctgatgaataccggggaaaaagcaattaagtccgaacatgggcttttgacaacaatcgcttggggcattgacggaaaagtgaactatgcgttagaaggaagcatttttgtcgcaggctctgccatccagtggcttagagacggattgagaatgttccaggactcttcgcttagcgaatcttatgcagagaaagtggattcaactgacggcgtatatgtcgttccggcctttgtcggactgggaacgccttactgggacagcgatgtgcgcggttcggttttcggcctgacaagagggacaacaaaagagcactttatccgtgcgacactggagtcattggcttatcagaccaaagatgtgcttgacgcaatggaagcagattcaaacatttcattaaagacgcttcgtgtagacggaggagctgtgaaaaacaatttcctaatgcagttccaaggagacctgttgaatgttcctgtggagcgcccggaaattaatgaaacgactgcacttggcgcggcttatttggcgggtatcgctgtgggattctggaaggaccgttctgaaatcgcgaaccagtggaatctggataaacggtttgagcctgaattagaagaagaaaaacgaaatgagctgtataaaggctggcaaaaagccgtgaaagcagctatggcttttaaataaagtaatactatggtataatggttacaagttaataagaacggtcctgagatgaggagagaccacagcaccaaagtgtaagcatgcactttggctgttgtggtctctttttctatttaccgtgacaacaaggaggagacgtaatgatgaaacatcaattttcaagtcttgaaagagatcgcatgctgacagacatgacgaaaaaaacatatgacctatttattatcggaggaggaattacaggagccggaacagctcttgacgcggcatcaaggggaatgaaggtcgcactaagcgaaatgcaggactttgcggcgggaacatcaagccgatcaacgaagctggtacatggcggcttgcgctatttaaaacaatttgaagtgaaaatggtcgctgaggtaggaaaagagcgggcgattgtgtatgaaaacggcccgcatgtcactacaccggaatggatgctgcttccgtttcataaaggcggcacattcggttcatttacaacatcaatcgggttaagggtttatgacttccttgcaggtgtgaaaaagtcagaacgaagaagcatgctttcagcaaaagaaacgctgcaaaaagaacctttggtaaaaaaagacggcttaaaaggcggcgggtactatgtggaataccgcactgacgatgcgagactgaccatcgaagtcatgaaggaagcggtgaaattcggggcagagcctgtgaattactccaaagtgaaggagcttctttacgaaaaaggcaaagccgtcggcgtattaattgaagatgtgctgacaaagaaagaatataaagtgtatgcgaaaaaaattgtcaatgctacaggcccttgggtcgatcagctcagagaaaaagaccattcgaaaaacggaaagcacttgcagcatacaaaaggcattcaccttgtatttgaccagtctgtctttccgctgaaacaggctgtatatttcgatacacctgatggccggatggtatttgcgattcctcgtgaaggcaaaacatacgtgggaacaacagacactgtttacaaagaggcgctggagcatccgcggatgacaacggaggatcgtgattatgtcatcaaatcaatcaattacatgttcccggaactgaatatcactgcgaatgacatcgaatccagctgggcggggctgcgtccgctgattcatgaagaaggcaaagatccttctgaaatttcacggaaagacgagatttggacatctgactcaggcctgatcaccattgccggcggaaaactgactggatacagaaaaatggcggagcacatcgttgatcttgtccgtgatcgcttaaaagaagagggcgaaaaggattttggaccatgtaaaacgaaaaacatgccaatctctggcgggcacgtcggcggttcgaaaaatcttatgtccttcgttaccgcgaaaacaaaagaaggaattgcagccggtttatcagaaaaagacgcaaaacagctggcgatcagatacggctctaacgtagatcgcgtctttgaccgggtagaagcgctgaaagatgaggccgcgaaacgcaacattccggttcatattcttgctgaggcagaatacagtatagaagaagagatgactgcaactcctgctgacttctttgtccgcagaacgggacgtttattttttgatatcaattgggtaagaacatataaagatgccgttattgattttatgagcgagcgattccaatgggatgagcaggcgaaaaacaaacatacagaaaacctcaacaagcttttacacgatgcggtcgtaccgcttgagcaataaatcataacgggctgtctgcagcccgttatttctttttacgtggaaagggccagatctcaggttatcaagtgacagaggcacccgcttcatataaaataatggcataagctgatacataggaggacgaatatgacttggagaaagagctatgaacgctggaaacagacagaacatttagatccggaattaaaagagcgccttattgaattagagggagatgaacaggcccttgaggactgtttctataaagaccttgaattcggtaccggcggaatgcgcggggaaatcggcgccgggacaaatcggatgaatatttacactgtgcgcaaagcatcggccgggtttgcggcatacatctcgaagcaaggtgaggaagcgaaaaaacggggcgttgtcattgcttatgattcccgccataaatctccggagttcgcgatggaagcggcaaaaacacttgcgacacaaggcatccaaacatacgtgtttgatgagcttcgcccgacgccagagctgtcattcgctgtcagacagctgaacgcttatgggggaattgtagtaacggcaagccataacccgcctgaatataacggctacaaagtatacggggatgatggcggccagctgcctccaaaggaagcggacatcgtcattgagcaggtaaacgcgattgaaaatgagctgacgatcacagtggacgaagaaaataagttaaaagaaaaaggcttaatcaaaatcatcggtgaagatattgataaagtttatacagaaaaactgacgtccatttctgtacatcctgaattatcggaagaagtagatgtaaaggttgttttcacaccgctgcatggaactgcaaataaaccggtcagacgcggacttgaagcactcggctacaaaaatgtaacggttgtcaaagaacaggaactgccggattcaaacttctccactgttacatcgccaaacccggaagagcatgcggcattcgaatatgccattaagcttggggaggagcagaatgcagatattctcatcgcgacagatcctgatgctgaccgcctcggcatcgcggtgaaaaacgatcaaggcaaatatacagtgctgacaggaaaccaaaccggagcgctgctgcttcattacctgctttctgaaaagaaaaaacaaggcatcctgcctgataacggtgttgttctcaaaacgatcgtcacaagcgaaatcggccgtgctgtagcttcttcattcggccttgatacgattgatacgctgacaggctttaagtttatcggtgaaaagattaaggaatacgaggcatcaggccagtataccttccaattcggttatgaagagagctacggttatttaatcggggattttgcccgcgataaggacgccattcaggctgcgcttttggcagttgaagtttgcgcgttctataaaaaacagggaatgtctttgtatgaggcgctcatcaatctctttaacgagtatggtttttatcgtgaagggctgaaatccctgacgctgaaaggcaaacaaggagcagagcaaattgaagcgattcttgcttccttcagacaaaatccgccgcagaaaatggcggacaaacaggttgtcacagcagaagattacgcagtaagcaaacggacgcttctgactgaaagcaaagaagaagccatcgacttgccaaaatcaaatgtattgaaatacttcctggaagacgggtcttggttctgtcttcgtccttcaggaactgagccgaaggtgaaattttatttcgccgtaaaagggtcatctttggaagacagtgaacagcgtcttgcctccctttctgaagatgtaatgaagacggtggatgaaattgttgagtcaacagcaaaataattcaagtatgagctgggtcattgtaaatgatccggctttttctttttctcatccaaaagtctgaaagaaaatcatcctacaagtgaagcaatgaaatacaaaaaactggtataatcttaaatacaagatcaatgccggagtgagaaacgtgagcaaaacgaggatggaaaaattaaaaacgctgaaaacgattgcggaaaccttaaatcaagggcacgatatcaaagcaacactggatgaggttttaaaagagttgctgagtctgacaaatcttcaatccggatggatttttctgatcgaagaagatggatcttatacgttagcggccgacgctaatctgcccccggctttaagccgcaaggaaaaagtgctgatgtgcgaaggggagtgttactgcctgacgaaattcaataacggagggcttagaaaggctgcaaatatcatgaactgcaaacgcatcgaatcagcagaaaacctgcattgttttgacacagaagggattacgcatcatgcaactgtgcctttagaagacggggacagaagattcggattgttaaatgtagcggcggccggaaaaaccatgtttgatgaggaagagctgcatttactcgagtctgtcgcctttcagatcggaacggcaatccagcgtatgaggctttctgaatatcaacaaaaaaatgctcttttaatggagcgtaaccgcctcgctcaggagcttcacgattcagtcaatcaaatgctgttttccgtcagtttaactgccaaagctgcgaagacactaacaaaagatgagaatttacagcagatgattgaattcatccaaaacctatcacaggacgcgctcgcagaaatgaaagcgttaatttggcagcttcgccccggaggattggaaaaagggctggctgaagccattaaaagctatggtgcactcattggattgaagatcatttttacacaaaaaggctgtcctgttctgactgatgagcatgagcatatgctatggcgtgtcgtacaggaagctttaaataactgcaaaaagcatgccggaacggatacggcgtatgttagtctgactgcttctttgtgccatgcggagctggatatcatcgatcatggggcaggatttcgctatgaagcgcataccggtctgccttcacttggcatcaagggtatgaaagaacgagcggaaaaagccggagctaagttttggattgagtcagcgcttggaactggaacaaagctgtccatcaggcttccgctaacaagccgaaaaggaggggcggtatgaaaattgtcattgctgatgatcatcatgttgtcagaaagggtctgcgttttttctttgccacccaggatgatattgaagttgtcggagaagctgcaactggaatagaagctctccgtgtcatcgaagagacaaagccggatcttgtgctaatggatctgtctatgcccgagatggacggcattcaagccattaaaaaagcaatacagcaatttccggagacgaatatcattgtgctgacgagctactctgatcaggagcacgtcatccccgcgcttcaggcaggcgcgaaggcgtatcaattaaaggatacggagcccgaggaattggtgaaaacactaagacaagtgcatgctggcgaatacaagctttctacagctattatgtcccatgtgctgacacatatgaaaaatcagcacgacccggaaaaagaaaaatactatcaattaacaagaagggaaaaagacgttctgactgaaatagcgaacgggaaaagcaataaagaaatcgcagcatccttgtttatttcagaaaaaacagtaaaaacccatgtatcgaatcttttagcaaaacttgaagtggccgatcgcacgcaagcagcgcttttcgcagtgaaatataacctgaatggagagatcttaaaatgaacatgttagtcataaatggcacgcctagaaaacatggcagaacaagaattgcagcttcctatattgcagctctgtatcacacggatttgattgatctaagcgagtttgtattgccggtttttaacggtgaagcggatcaatctgaactgttgaaggtacaggagcttaagcaacgcgttacgaaagcggatgcgattgtattattatcgcctgaatatcacagcggcatgagcggcgctttaaaaaatgccttggattttctaagcagcgaacaattcaaatataagcccgttgcattattggcagtagcgggaggcggaaaaggcggcatcaatgcgctgaacaatatgagaactgtgatgcggggtgtctacgccaatgtcattccgaagcagctggtgcttgatccggtgcatattgatgttgaaaatgctacagtggctgaaaacattaaggaaagcataaaagagcttgtcgaagaactcagcatgttcgcaaaagcaggaaatcccggcgtttaaacgccgggatttgtttatgtgagaagggctatttgatcttcataagtcagctctgtggcatgatcaatataacggagaagggaatacagcatcttttctaaaacggcgtaatcctgttcaaaatgatatgcatgcagaaaatgctcaattcgttttgataacaaatcgtcctctgtacgcaccattaaaattaataaattatcccattgagaacgatgggtgtaataaagcgctttatcgtaatcggcataatccatgaatcgcttctcctttcttgggtgagaagttcatgattagtttatgccgcatcctctgttattgacggggcaaaacttgccgtctgcgtaagtaaaggggtagcaatatgagggagacataaaatcaaaatgcctgaatgaagatatcgcttttggtaaacctatgagggaacatattctgggtacaggagactgaaaaaatgaaatccctgccgtataccatcgcgcttcttttttgcggattgattatcgtgtcaatggctgcaaaaggtcattcaacggacacagacgagtccgttcaaaagtgggaacagcttgcctggagcaaaattcaggatgaatataagggcgcttcattttctgattatgcttatatggggcgtacagaggtgaatgatcagcagacgaaagatgtctttcgggtgacagtcagacagaaagatgacactttttctgttcgggccgaagtctattttcatccggtgacaaatcatatgatcagcatcaacgtctttaggctctaataaaaaactgtacagccgttaaggccgcacagtttctgtttttagaaatatcgttttgcaccgagatagcgctgtttccagtaagagttgttcatattggaaatgacaactccggaatcgttggcatttatgaattccccgttgcctaggtaaattccgacgtgggaagggccggctttatatgttgtaaagaaaacaaaatctccgacagcaggctggctaactgatttcattgtgttccaatatcccgctgccgttaatctagatacggatgtgactttattcagtacatagtaaatgaatccgctgcagtcaaacccggacggtgtcgtgcctccccagcgatacggaaccccaagctgcgctttagcggccgaaatcattgtgttaatcttcgcactcgttgagctggtgttgtttgaagaaccggatgaagacgatgatgaagcttttccggaaatgaccagcttttggccaacctgcaagacatccgtttttaaattgtttttctcacgaatctgctgagctgttactttaaatttttgagcaatcacccacaaggaatcaccgcttttcactgtgtatgtagtcgtcgtgcctgagcttgcatttgacgaagaagacgacgatgatgaagagcctgaagatgctttacctgtcagcttcaatacttgtccaacgtacagcacatctgatttcagattgttgatatttcggatttgctgtacagacaggttatagttgtttgcgattttccaaagtgaatcaccgcttttaacggtatatttagttgttgctgaagtttggttcgatttggatgaagtgtctttagaagacgtatcagagccgcttgattttgttttcaacacctgattcacgtaaatggtgtctgattttaagttgttcaagaccttcaattcagcgatggacatattgactttgtttgcaattttccagagtgaatctccaagctgcaccttatatgttcccgtagaagatgaggaacttgaactcttattagaactgctttttgaactggagcttgaactcttattggaactgctttttgtactggaacttgaagaaacagtaccggacacctttaatttctgcccagcacgaattaaatcgctgcttagtccgtttaattttttcagttcctgcaccgtcattttaaactcatttgcgatcagccaaagtgaatctccgcttttcactgtgtaaacagaacttccgctcttcttggttgttgagcttgaagtagatgaagaagtgctggatttgctgcctggaatagtaagcgtctggccgatcgacagaacagtagtcgaaagatgattggcggatgtgagggccgccacacttgtgttataggtttgggccagtttccataaagaatctccgcttttgaccttaatcgttgctgcttcagctggtgtcactactaaagttgtgccgacaatcgcagatgctgtcagccctgctgctaatttctttttcatcttagctctcctttttcccccaatgattttgcatttgctgtttcttttttatatcggcacatttgtctcatcgttttgcctttttataaaaatagccaaattatcttaacaataagggggaaaaagggcataaaaaagaaggaatcttgatctattccttcatttttaaaagcttcatgatatcttctttgtttttgacgaggtcgcgcagtgtgtatttgtctaaaactgcgaggtaggccaaaagcgcttcattcagcacatgttttaagccgcaaaccggggaaataacacagagattcttattcgcatcaaaacattcaacaatattaaaatcgtcctccgtttttctgacaacctcaccgatgttgatgtcttcaggttccatgcctaatcgtatgccgccgccccgtccgcgtatcgtttctacgtagccgagctggccgagcctgtatatgactttcatgagatgattttttgaaatagaatacgtttcggcaatctgttttatatttgaaagttctccgggacgctctgcagccagaaaaatcaacactcttaatgaataatctgtataattggttaacttcataataagacctcagaataagacattttctatatcttatcataatcgattgaaaaatgaaaaaaaaggaattaaaaaaacatgcacccagctgggtgcatgttttttgcttacatgtcattcggcggattttggttttttcggtttttttcgatttctgtgttttgcattttgcgttcaaatgtagacagataacgtgatgcaaaatccttaccgccaaggccgaaggataaaccgaaagcgagtgcgaagccgctaagaacgatgatgaacgcggaattgacgattgtcgcagcgacaccaagctgatccagggccataaagaaagcaagtgcgataatcgtatatttagcaataggcgctaaagacttgaattcctggccttttatcatgcttgcgagcacttttctcaccaattctcctgcgtaaaggccgagtccgagaatgaatactgcgacaaggacattcggcagatacgcgatgatgccagtggcaatttctacgaggaagtgcagccgaacaatttgaagagcctcagctgtaaagagcagaatgacaatgatttgcgcaatcataccgacaacttgagacaaggacagctttgcaggcgttccggcttccatgcccattttccctaagacagaatcaaagcctgcgcgatggagcagtccggacaccatggatttcacccattttcctgcccagatacctgctaaaacaagcacgatggcaatcatgatgttcggaagcatgtttaaaatcgtattcagcatagagacagccggttttgaaatgccggagacatccagctgatcaagcgctgaaatgaccaccggaatcataatcagcacataagcgattgttccgatgactgctgaaaggcttgtatcttttaagtaaattgataaacccatacgtgccgcgaatctttccgtgccgatgcttgcaaggaaattcgtaatgatatcacgaacaaggcgggcaacaagccagccgattaatacgataagcgccgctgcaaataatttcggcagaaaagcgagcacgctttccatcatatttgtaaaaggacctgaaatgccgctgattttcaaagaagataagacccctggcagaaaaacaagcagcacgagataaaagacaatttgtgaagcggtattgacagcctggtgaatatcttttccttcagacaccaaattccacttgcgcagtttgtcactcgtgttcagcttcatcccgatttttttgacaaggaagctcaaaacagaggctgcagcccatcctaacagcagaatgagtccggctttcagcacgcttgggatcgcggctgcaatcgccgaaagcatactgacaaacggcgatgccactgttgtcaggtgcaaaatgttaaagaataaaataaagacgatgatcagtgcgataaaataaacgaccttgcttatgactttttccgaggaatagcgtgaaggctttttcccagcaaagagcttgtcgtcaatttttgttttgctgagtcctttgtataccgctttttcaatgattttagcaatagcccatccgattaataagacgagtaaagcaatgattacgtttggcagcttactgagataagaagaaagcacgtctgctacattcaattggtatcgctcctttttcgtagtatggtgtgtgtttacccactgatccaataagaaaacagatgaatgtgccgggggaattttttcttgcccgagtgagactatcatcttttgtctggcgggctcatacattatagataagtccaagtaggggggattcggttgaacgcggaggagaagaagggattacagcgggcaattgaggaaattaccgaaattgcaaaaggattcggccttgatttctacccgatgagatatgaaatctgcccggctgaaattatttatacatttggcgcgtacgggatgccgacaagattcagccactggagcttcggcaagcagtttcacaagatgaagctgcactatgatctagggttaagtaagatctatgagctggtcattaactcagatccatgctatgcttttttgctggacagcaactcactgatccaaaataaattgattgtcgcacacgttcttgcccattgcgatttcttcaaaaacaactgccgtttccaaaacacgaagcgcgatatggtggaaagcatggcggcaacagctgaacggataaaacactatgaacaggttcacgggataaaagaagtcgaatcttttttagatgcgatcctttcgattcaggagcatatcgatccgtcgttggtccgaccaaagctccaatggagtgtggatgatgaggaagaggagattgaagaggcagccacgccttacgatgatctatggtctttggatgaaaagaaaccgaaaaaacaagtgaaaaaatcgaaaaaaccgttcccgccgcggcctgaaaaagatatcctgctttttatcgaggagcattcccgggagctggagccatggcagcgtgatatattaacgatgatgagagaggaaatgctttatttctggcctcagctggaaaccaagattatgaatgagggctgggcttcctattggcaccagcgaattatacgtgagcttgatttaacctctgatgaagcgatcgagttcgccaagctgaatgcaggtgtcgttcagccgtccaaaacaggcattaatccttattatttagggctaaaaatatttgaagacattgaaaagaggtacaacaacccgacggaggaaatgaagaaaatgggcgtgcagcctgactccggccgggagaaaatgtttgaggtcagggagattgaatccgatatctctttcatccgcaattatttaaccaaagaattagtcatgcgcgaggatctttatttgtttcaaaaacagggccgagattataaaatcatcgataaacagtggaagtcggtgcgcgaccagctcgtaagcatgcgggtaaatggcggttttccatatttgacagtaaacgacggcgattatatgaaaaataacgagctctatattaagcattggtatgaaggaatagagttagatttgaaatatttggagaaagtgctcccttatttattccagctttggggaagaagcgtgcacattgagtctgtgcttgaggataaggaagtcatgttttcctacgacggaaaaggtgttcaccgcagatatttataaaaaagaggatgcagcgttctgcatcctttttattttccagtttttaaaatcttaaatatgatgtttgcctggtccgtattgttaatcaatccgcggaatttttcttttccggggccgtacgcgtataccggtacttcttcgccggtatgatcggtactcgtccatccgctgttggagcgagtattaaaaatcttgatgatggctttgtaggcccctttgcttttgtcagcctgtgcagctgcttcaacgcttttgatttcttcagatgtgaatttcagattggcatagcgggcgagcacatctttaaccggcttgccttcactgatttttttggccatgaattcaggtgttttcttagcggagagaatcggttctgcgtgccaattcttttccccgtttgcgccaatggtaaagccgccggttgtatggtcagcagttgcaatcacaagtgtatgtttgtcttttttcgcaaattcaatcgcggctttataggcctgttcaaaatctttaacctcgctcatagctcctactgtatcattgtcatgggccgcccagtcaatctggctcccttcgaccatcaagaaaaatccttttttattttggttcaggcgatcaattgctgaaacagtcatttctttgagagacggtgttttgctgtcacggtcgagcgccttagcaagccctccatctgcgaaaagcccgagcacctgctgatctttatttttcttcaatgcttgtttagttgtcacatagctgtagccggcttgtttgaattcctttgtcaagtttctgtccttgcggttaaaataagattttccgccgccaagcaaaacgtctattttatgtttgccttttattttgtcatccatatagctgttggcgatttcgtccatgtttttccgtgattcattgtgggcgccatatgcggctggagtggcgtggttaatttcagacgtggcgacaagccctgttgacttgccttgctgtttggcctcttcaagtactgatttcacttttttcccgtttttatcgacgccaattgcattgttatatgtcttaacgcctgtcgctaatgctgttccggctgctgctgaatctgtaatattatagtcagggtcatccggatgcgtcatcatcatgcctgtcaggttccggtcaaattctgttaacttcgggttattcggtgtgtcaccgttatttttcatggaacggtaggctcttatgtaaggcgtccccatgccatcgcctatcatcacaatgacatttctgatctcagctttgttttgttttttggcgctggccttttctgtttgctgcagctcagctccggcaaagattccagctgtaaggacagaaacagcggcgattggcagaaattttgatttcatattttgaaacaaattcattttttcatgcctcctttaatgtattccgtttatcacgttagggaaattttgttaaatgcggctgctgatcatgtaaacaataagtaaagccttgtaaggaaaatgaaaaaacgcttttcgttatcttgccttatttgatgtaaagcattcatttttcagaaaaatctttacctctctgtctttgcatgatatgtttgtttaaataaaaaaactgcggataaccgcagctctcctcgaatattctttatcactcatttttccggtatgtgagccgaccccgaaagtttttcatttatttcctttatgttgaaaaacatcccataaaacatgacaaaagcactcgttttttgtcacctttgcaacgaaaatgaaatatttaatacccttaaaaacttttttttagaacgaataattaagaaatttgtcacatgaagtcaagactatttctgatgggaatctatccttataatagaaatcaataagattaattaaaaaaagagatacatatatagagagttaacatttggggaggaaaatatgaaaaagcaaatcattacagctacgacagcagttgttttaggatcgacgttatttgcaggagcggcatctgcacaaagcattaaggtgaaaaaaggcgacacgttatgggatctttcaagaaaatacgacacaacgatcagtaaaattaaatcagagaaccaccttcgttcagacattatttatgtgggacaaactttatcgattaacggcaaatctacaagttcaaaaagcagcagttcttcttcctcttcttctacatacaaagtaaagagcggggacagcctttggaaaatttcaaaaaaatacggcatgacaatcaatgaactgaagaagctgaatggcttaaaatcagatttgcttcgtgttggacaagtcctgaaactgaaaggttcaactagttcaagcagctccagctcatcaaaagtgtcatcgtcttcaacttctacttataaagtgaagagcggagacagtctttctaaaattgcgagcaaatacggcactacggttagcaaattaaaaagcttaaacggcttaaaatcagatgtaatctatgtcaaccaagtattgaaggtgaaaggaacaagcacaagcagctcaaaacctgcttcatcttcatcatcttcaagcagcaaaacgtcatctacatcacttaatgtgagcaaactggtttctgatgcaaaagcgttagtcggaacgccatataaatggggcggaacgacaacttcaggctttgactgcagcggattcatttggtacgtactgaataaacaaacaagtgtgggcagaacaagcactgcaggatactggagttctatgaagagcattgccagcccgtctgttggtgatttcgtcttcttcacaacatataaatccggcccttctcacatggggatttacattggaaacaatagtttcattcatgcaggatctgacggcgtacaaatcagcagcctgaacaacagctactggaagcctcgttacctcggtgcgaaaagattctaatttttagagaaaacccgttcattggaacgggtttttttcattagacggagcacaggcgttttggttgctcctaaaaatgaaaatgtgataaaaaatccaagaattttttttctttcttattttcataaagggcaatcgcgtaagcgccagcatagggcagctgtacagactgataaggaattctgatcatctgtttctctgctaactcacgctttactgtagataaaggcagaaatgaaactccgagtccttccttgataaaccgtttcgttatatgtgtttgagtgaccttcattgttctcacaaatggaaatgtcattctgacttgacggagcaagtcgtcccagtaatcaggatgattatgggtcaaaagcaggtattgttcgagcacctctttggcatcaatttctttgtcttctatgaaacgcttatcgggcggggcaacaaggacgacagggtctttgtataagcagtggcagcttaaagaagaagactgtacctttaaacagcttagtccgatatctgcttccccggctttaatcagtgacgcgatttccgctgattcgaaaatcgtaaccgccatttctgtttccgtattcattgctgtgtaccgtttcatgacagaaggaagcacagtatctgcaataagcggagaaaccgcgagctgtaaggtttgagagtagccttgtctcactctgtgaagctctgccatgctgttttcataatcatcaagaagcctgagcgcatacggcaaatacgccctgccttcatcagtcagctggatttgcctgcctttacgctcgaacagcttgcagctgatttctttttctaattgcttgatatgtacggtcacagtaggctgagataagtaaagcgtttccgccgtttttcggaagttctcatattttgcagcggtcacaaaggtgtgaagccatttgaaatccatttctattctccctctgattaatatttttaattaattccctttaaaatattcattattttttaaatattatatttactataataacagaaaaggatagggggaattcaaatggtacattacggattaaagggaattacatgtgtggaaacatccatcagccatattgatggtgaaaaagggcgtctgatttacagaggacatcatgcaaaagacatcgcactgaatcacagctttgaagaagcggcttatttgattttatttggaaaactgccttcaactgaagaattgcaggtatttaaagataagctggctgcggaacggaatcttccggaacatattgagcgcttgattcaatcactgccaaacaacatggacgatatgtcggtgctgagaacggttgtttcagcattgggggaaaatacgtacacattccatccgaaaacagaggaagcaatccggctgattgctatcacgccttccatcattgcatacagaaaaagatggacgcgcggtgaacaagcaattgcaccttcttcccagtacggacatgtcgaaaactactattatatgctcacaggcgaacagccttcagaggcaaaaaagaaagcgcttgaaacctatatgattctggccatggagcacggcatgaacgcatcgactttttcggcacgagtcacgttatcaacagagagtgatttagtgtcagccgtcacggctgctctcggcacgatgaaaggtccgctgcacggaggcgctccttctgcggtgacaaaaatgcttgaagacattggagaaaaggaacatgctgaagcatatctgaaagaaaaactcgaaaaaggagagcgcttgatgggattcggccacagggtgtacaaaacaaaagacccgcgggcagaagctttgagacagaaagcagaagaggtggccggcaatgaccgtgatcttgatcttgcgctgcatgtagaagcagaagcgattcgtttgctagaaatctacaaaccgggacgaaagctgtacacaaatgttgaattttacgcggctgcagtgatgaaggccatcgattttgacgatgaattgtttactccgaccttttcagcaagccgaatggtagggtggtgcgcccatgtactggaacaggcagaaaacaacatgattttccgcccgtcagcgcaatataccggtgccattcccgaggaaattctttcataacatattttggcgtttattcatttctgtcgtgtggtaacgttcagtatcaaccacatgtctaggagtgatgaatggtgaacccaatggacagacaaacagaaggacaagaaccgcagcatcaggacagacagccgggcattgagtcaaaaatgaatccgctgccgctgtcagaggacgaggattatcgaggaagcggaaaactgaaaggaaaagttgcgatcattactggaggcgacagcggaatagggagagcagcagctattgcctttgctaaagagggggctgatatctccattctatacttagacgagcattcggacgcagaggaaacacgtaaacggatcgaaaaggagaatgtccgctgcctgcttatcccgggagatgttggggacgagaaccattgtgaacaagctgtgcagcaaacagtggaccattttggtaaactcgatatcttagtgaacaacgccgctgaacagcatccccaggacagcattctcaatatttcaacagaacagctggaaaaaacctttcgcacaaatattttttccatgtttcatatgacgaagaaagctttgcctcacctgcaagaggggagtgccattattaatacgacatcgattaccgcttatgaaggggatacggcgttaattgattattccagcacaaagggtgcgattgtttcctttacgcgttccatggcgaagtcgcttgcagataaaggcatcagagtgaatgcggtggcgcccggtccgatttggacaccgcttattccggcgacattccctgaggaaaaagtgaaacagcacggcttggataccccaatgggaagaccgggacagccggttgagcatgcaggcgcctatgttctgctggcgtctgacgaatcttcctatatgacagggcagaccattcatgtgaatggcggccgttttatttcaacgtgatcaacgaaaaaccagctctagagctggtttttttgtgtggtaaaaaatttcaaaataaaaaatttgtcgatttttctaacaattttgttttcatttttgcaattttatatataatattgagtaggagaaaggaatgattcgcgaccagtacaaatatagtagaaaaaaagaaaaatgaccattgttactcatgaattcagaaaattcaaataaaatatataaaaatagatgatcgggagttgaaggggaatgaaagggagcgtttttaggaagaaaagcattcaggatttaatcgctgcgacgagcggggaaaaatctttaaaaagagaattaggggcatttgatttaacgttgcttggaatcggcgccattattggcacagggatttttgttctgacgggaacaggcgcagtcacggcaggtcccgggctgacgatttcatttgttgtggcggcgttggcttgtttattcgccgccctgtcttacgcggaatttgcgtcaagtgtgcctgtttcaggttcggtgtatacattcacttatgcgacattgggagagcttatggcctttattatcgggtgggatttaattttagaatacatgctggcggtaagtgcagtgtcggtcggctggtctggttatttccaatcgtttttatcagggctcggcattcatcttccggttgctttaacagcggcaccgggcgcagtgaaaggcacctttaccctgtttaatcttcctgcattcgtcattgtaatggcgatcacatatttgctttatttaggcatcaaagaatcaaaaagagtcaacaatatcatggttatcttgaagatactggttgttctgctgtttatcgcggtggcagccgtttacgtgaagccgcacaactggcagccgtttatgccaatgggctttggcggcgtattcagtgcagcggcgctcgtattctttgcttttatcggatttgacgctgtatcctctgctgcggaagagacgaaaaatcctgcgaaagatctgcctaaaggcattattttctctttactggtctgcacgattttatatgtcaccgtatcagcgatcatgactggggttattccgtttgctcaatttgcgggtgtggatcatccggtttctctagttcttcaaagcgcaggacaaaactgggtggcaggcatcattgatattggcgccgtgttgggaatgacaacagttatgctcgtgatgctttacgggcagacacgcgtcatgtttgccatgtcgcgtgacggacttgtgccgggttcactttctaaagtgcatccaaagcacaaaacaccttatgtagccacttggtttttcggaacgatgtcggcgcttctcggctcacttgttccgctggatgaacttgcaaagctggtgaacatcgggacgctgtcggcatttgtacttatttctgtggcagttatcgttttgagaaagaaacagccggatcttccgagagcctttaaatgcccgggagttccgtttatcccgggcctggcaattctgttctgcctgttcttgattttaaatctgggatgggtgacgattgtccgcttcctagtgtggctgttaatcggcttggtaatctatttcctgtattcaagaaagcattcaaaattaaatcaataaccttttgataaagagagcggccatacaggccgctctcttttctgttcctggcaaatgaatctatagaaatgaagacaaaaataagagataatataggctggaaaggaagtgacgtttattgtctgagcaaaaaccagtccaatgggcttcgaaaatcggtttcgtcatggcagccgccggctcggctatcggcttgggcgcgatttggaagttcccttacgtagcggggaccaatgggggaggagccttttttcttatcttcgtgttatttaccatcctcttaggctatccgcttttggtgggggaatttatttttggaagacggaaccagacgaatgccattgatgcatataaaaaagaagcgccgcgatcagcttggtttcttacagggtggatcggtgtagccgcgtgtttcttagtgctgtcgttttacagtgtaatcgggggatggattttgctgtatatcgtgaaaacagcgtcaggatcactgtccgggctttctcaagcacagtatggcgctctttttgcttctattatccaaaatccggtgcagacgctcgtggctcagcttgtctttatggtacttactgtcatcgttgtcgcaagaggggttcaaaaagggattgaacgggtaagcgcggtgatgatgccgattttgtttttattgtttattctgctcgttcttcggtctcttacgcttaatggtgcaatggaaggcgtaaagtttctgcttgtgcctcatttcggcgatctgactccggaatccatattattcgcgctgggacaggccttctttacgttaacactgggggtttcggttatggtgacctacagctcctatttgccgaaaacacaaaatatccctcgttcggcagcctccattgtcttgatgaatatcattgtgacactcttggcaggtttggctatttttccggcggttttctcattcggttttcagccaaatgaaggaccgacactgctgtttacagtgcttccggccgtttttgaacagcttccgttcggcacgttgttttttatcggttttctcgttgcatttttatttgcagccttaacctcagcattttcgatggttgaaattatcgttgccacaatcggaaaaggggacgaaaagaagagaaaaaaactgtcatggacgagcgggcttttgatctttttggtcggaatcccatgctgcttgtcttatggcgttttgagtgatgtgcacctatttggcaaaacgttttttgatattgccgattttaccgtcagcaatgttttgatgccttcaggcgctctgttaatttctctatttatcccgctgaaaatttcgaaaagcgaactcttggctgaaatgcgaaatggatcaaatgcaggtaaagcattcttttacacgtggttttatttgcttcgttttatcgtgccgcttgccattattatcgtgttcttaaatttaatcggaattttatcattttaaaaaaacaggctccgtttccggggcctgttttttatttaataagatgatatcaacggtgcccatgccgttttcagtttttggatgccgagcctgatgtcctcttctgacaaaccgccataaccgattaagacagaagcaaaaggcgtctgttctttatatgagggagacacgggatagatggttacaccgtggtctgcggctgcttgtattgcttcttcctcacttgctggaaacaaaaggcgcagcaggatgtgaagccccgagttcttaccgagaatctcaacggtgtttcccagttcagagcggatggcttctaacaggacagcgtgtttttttcggtataagcttctcattctatttatgtgtttttgccactctccggtttcgatgaagtctgccagtgccaattgtgagtgggcagaaacggtctgcttcattaactgagcattgtttttgatcggttccatgagttcatggggcacaatcatgaagctgagccgcaaggaaggcagaagtgactttgaaaaagtgcccagatatatgactctgccattcggatcaagactctgtaaagacggaatgggatggccgctgtagcgaaattctccatcgtaatcatcttctataatgaatgaatttgtttctgccgcccatgccagcagctcctgtctgcgggtaatcgtcataatggtcccaatcggaaactgatgcgaaggagtcgtatacatgagataaggattctgacggtagagctcatccggcaggacgccttctgcatcagaacaaatcggagtgacatccatgtgatttgcttcaaacatccttcttgaacggtgaaagcccggttcttcaaagccgatttttgtacctggctttagcgaaaggcaaagaatttgcagaagcacggtggttcctgcgccgatgataatctggccgggttcacaatttactccccgagacagcctgacgaatcgggcaatcatgtgcctgagttcgtattctccttgagggtcgccagaggtgtgaaacgatccggaatagcgatcaagactttttactatgctttttctccatgcgttaaagggaaagagggtcgggtcaacgctgccctgatggaagtcaatagcaggtgcgttcttttcatgtaatcccggctgtacagactgctgaaaatggtcaggagctgtcgggaatcctggttctacttccgccgcgaaccagccgatttttggcttgcttttgacatagccctcagcagttaattgctcataagctcgttctatagttgccgtgctgacatcgagcaagctggagagcctgcgttttgacggaagtcttgttccctttgtgattcgcgcatgtgaaatttctagtttaaaaaaggtataaagctgctcatacagcggtgttttgctctttttatcaagaaacggcgtgatatccatctcgtgtctcctttttatctggcatggttattttttctgatattggctatttggcaaatgccatttattagctatgatcattgtaacgaaaggaaaggggattgagaagatgatccatatgaaacaattaacctcgaaagaagaatgggctgagtcgtatccgattatgagtgaattgagaacagaactggatatagagacgtatttacaaaggcttgaagcctgtgtgcagaaagaatcgtatatgctgtttgccttatatgaaaatacagcaatcagagcgctgtgcggggctctgccgagagtttccattcataaaggagagcacttgtggattgcggatcttgttacaacggcaccttgccgatcaaagggatacggcaaaatgcttttggattatgcctcagactgggcgagaaaagccggacttggttttgtcagtctttcatctggccttcagcgtaaagacgcacatcgattttatacagataaaatgggttttactatagaaagttatttgttccgaaaaccggtataacgaaaaaagacgcctgaaaaggcgtcttttttaaaagccaaactgtaaattcgtatctacagatacaatggtatacacacaaataatcacaaagagattaaggatgacgccgagcaggccggggcctgtgcgccctctcttgatgaagagttcaacaacgccgaacggaacggcagccatggcgaatggaagcatttgataggaataaaacgtgacattgctgataatggccaaattcagcaacagcagggacagaaccgctgtcccgacagagatccagccgaatacattgtgttctttaaaaattcttaccagttccataattccacctcgccgacattcgctgattttacagatttatttttcagcatgcgctggatttccttggttggccctgtaacgaccgaaccgtatacattgacaccgtttttctctacataatctaatcggttatctacattcaggtctttccgttttgaaatgacctgagcccatttttcgtgtttggacatgaattttagggcgttgataaactgatcgccattcgacttgccttttgtattaagggcggccaagaactttgaatcctttccaggatagccaagaggttctgtggaagctgtcttatttgtgtttttctctgtttcgattgcgttccacaaaaagctcacatcatagcctttgaatttgttatacacgtcttttgtcggatatgcacggtcatatgaaaggtagacctctgataccgttccttcaggcaatgtgcttaacgttttttctgcttttgcggtcgtttgttcagacttgtttgaaggatgtgtaaagtaatgtccggttttattcacttctaagtcatagtagtttactgccggcgcttttactttgttataaaacatttcaacccgttcattccctacggcagccgtcttcgtgccaatctgcttttgcagcgggaattccgtattcattccaaatagcttcacttggcttttcagtccggaagtatcaacaagaacattcggcatggtcagggctacagtgactgcggcagtttccataaactcattgccggtgctgtgtttcccacccattccgtaatagaggtagcttcccagcgtacaaagcggcaaaatcatcaatgtcgaaatgacggcaagcacagaaattcgcaaataagacttgcgtttgccgtaggctaaaatcgctttttgtttttcaggactgatgctgagatcccaatcgttatcgtcctctagttcgctgtcaatcagttcctgatatacttcgagcttctcaagttcttcctcaaatgcagtcatttcctggtcgctcatttccccatttttatattgatcaaaacgctttttaaattcttcattcatcattaacacctctattataaagtgctttcagccgctgtctggcacgaaataaaacacttttaaaattcgcctctgaaatattcataatatgggatgcttctttgtagtttaactcttttaaataatatagcgttaaggcctcccgataattatcggggagctcggacatataaccagtcagcacttcctttatctctacctgatgggcaggactttgaacagcattttgaaagaggcttccgattaagtcatcagaaatggttacttctttcttatgctttctgacgtaatcaatgaaggcgtttcgcgccacttgaaaaagccagggctttactttgctgtgatcataggagtgaatgtgtatgtatgcccgcataaaggtttcctgcagtaagtcttcagcaagatgcttgtcttttgtcatggagagcaggaacctgtaaacatcattcatgtacatttggtaaatttcatcgatcgtcactgccttttctcccctctatgttatacacgcataagaaaggtttaaagttgcacattacatgcaaacggcttttttatacctaatcaaacaccattactatatagtacccaaaaatggccgcaaaagatagtgcggagaaaggtttaacattttttccagaggggaaaagatagtgaaaaagtgaaggagtggcacaatggaatataccagtatagcagatacaggaatagaagcctccagaatcggcctcggcacatgggccattggcggaacgatgtggggaggcactgatgaaaaaacatcaattgaaacaatccgcgccgctcttgatcaggggattacactgattgacaccgcgccggcttacggcttcgggcagtccgaggaaatcgtcggaaaggcaatcaaagagtacggcaaaagagaccaggtgattctcgcaacgaaaacggctctggactggaagaacaaccagctgttccgccatgcgaacagagcgagaattgtagaggaagttgagaattctttgaagcggcttcaaacagactatattgatctttatcaggtgcattggcccgatccgcttgtgccaattgaagaaacggctgaagtcatgaaggaattatatgatgcgggaaaaatccgggcgattggcgtcagcaatttttcaattgagcaaatggatacatttcgcgccgtcgcacctctccatacgattcagcctccatataatctgtttgaaagagagatggaagagagtgttcttccttatgcgaaagataacaagataacaacattattatacggcagtttatgcagagggctgttaacaggcaaaatgaccgaagaatatacatttgagggcgatgatctgcgtaatcacgatccgaaattccagaagccccgctttaaagagtatctttctgctgtcaatcaattggataagctggcgaagacacgttatggaaaatcagtgattcacttggctgtcagatggatcttagatcagccgggagcggatatcgctctttggggagcaagaaagcctgggcagcttgaggccctatctgagattacaggctggacgctgaacagtgaagatcagaaagatatcaatactatattggaaaatacgatatcagaccctgtcggaccggagtttatggccccgccgaccagagaggaaatataacaaaagctgagggcgaatcctcagctttttggcgttttaacgggagaaatcttaaaaattagtaccaggtaataaaaaatgttgttataatagaagatagaaagaatcattgattacgacaaaggaagtgcgatatgtataagttttgtgcaaatgctttaaaagttattctttctcttcgcggaggagtgaaggtgtataacaaagaaaaccttccggccgattcaggttttgtcatcgcgtgtacacattccggctgggttgatgtgattacactcggagtcgggattcttccttatcaaatacactacatggcgaaaaaagagctttttcaaaataaatggatcggttcgtttctgaagaaaattcatgcctttccggtagatcgggaaaatcccgggccaagcagtattaaaacgccgattaagctgctgaaagaaggagagatcgtcggtatcttcccaagcggaacaagaacctctgaggatgtgcctttgaaaagaggtgcggtgacgattgcgcaaatggggaaagcgccgcttgtccccgctgcatatcagggcccttcaagcggaaaagaattattcaaaaaaggaaaaatgaagctgattatcggtgagcctcttcaccaggctgattttgcccacctgccttcaaaggaaagacttgcagcaatgacagaggctttgaatcagcggattaaagaactagagaataaacttgatcagctataaggcgttctgagagattgccctgaaactgtgaaaataagaaaagcaccttatacaaggtgcttttcttattatgcttcctgctggttagctgtctccagaagttcttcttcttgaagctttttcacttcaatatatgcgacgtggtggccgtcaatttcattaatgatgaattcgcagccctcttcgatgatggaatcatctttttcaacatcgtatttttgagtaaggaaccagccgccgattgtatcgacttcttcgttctctaaatgaatgcctagcaggtcgtttacttggtcaattaacacttttccgtcaagaatataatggccttcgccgattttgcggatttcgctaatttcatcaatatcaaattcgtcgcggatttcaccgacaatttcctcaatgatgtcctcaaccgtcacaagcccggcagtaccgccgtattcatcagacaatatggccatgtggaccctctctttttgcattttgacaagcaggtcttggattggcgcagattcaatgacatgaatgatcgggttgacgaattgagaaatggtggaatcaacagatacctcaccgctgatgcaggcggtcagcacttctttaatgttaataaccccgataatgttatctttatcgccctcttccacagggtagcgggtatatttttcaatctgaatgatgtccatcatttcagaaatcttgatatcatgcggaaggctgacaatttcagtccgcggaatcataatttctttcgcgagcctgtcgtcaaattcaaagattttattcacatatttaaactctgattggttgatttcaccgcttttatagctttcagacaaaatgattcgcagctcttcttctgagtgtgccagttcgttttctgaaacggtctccaggccaaatgctttggtcaataaccgtgcggaattgttcaaaagccaaatgaatgggaacgcgatgcggtaaaaccaaatcagcggtttcgcaaacagcatagacactgcttccgccttttggatagcgactgttttaggtgcaagttctccgacaacaacgtgtaagaacgtgataatggcatacgcaaaaataaacgatatgacatgtgaaagggaacctggaacattcatttggacgaaaagcgggtgaagcagcctttcgatcgttgattcacctaaaacccctaatccgatggaagtcaatgtaattccgagctgacacgcagataaatattcatcaagatgcgtggtcactttttttacggctattgctgctttatttccttccgcgatcagctgatcgatccgtgagcctctgattctgataatggcaaactcagatgccacgaaaaatgccgtcagggcgattaaaacagcaactaaaatcaaattcactatgtccaattagaaccttcactctagcaatgagaatgaaggtaacacctcctgttagataaaatggttttaacttaacagcagcataaatgattggaacacggcgagcttttcaggcgggagtttgcttttcagcttgtcacgatcctcgggcttcagccgttcaaaccgatgcaagattccggagatgttttgattcatatgatcaatttctaatgccagatttccaatttcatcatcaagtttagctgaagagggaaactggttctccagtcgatctttaatatcggacagggccaatcgctgcttcttgcaatctacaataaatataagtcttttgagtgcattttcgtcgtagtaacggtaatttgaacaggatctggccggcgtaagcagaccaagattcgtataataatcaactgtccgtttcgttactccggcgagtgccgctagttcactgatgcgataagtctcagccccatctatatccctcccaaccatcacgttatagttatgagaatagtttaatatatgaatggtgtcttgcacaagtttattgttttttttagaccggaattggaagttgtggaattcatcatctgattgaagtaacataggaagatagaattttcaaacttttatatacggaagggacagatgaaattggctgggttatcccgggaagttgaagaaaacttaaataaaggatcatggattcgcaagctgtttgatgaaggtgcaaggctgaagaaggagttcggggaagaccaggtatttgatttttcactcggcaacccgattattgaaccgcctgaagcttttaagagagcgttaatagaggaagctgaaaaaggcagccacggatacatacaaaaccaagggcttcctgcagcgagagaaaaagtcgcgcaatttttggggtcgcgttttgaagctgatttctcagcggagcgtatcgtcatgacggtgggcgcggggggcgctttgaatgttgcgttaaaaagcatcgtaaaccctggggaagaggtcattattctcgcaccttattttgccgaatataagttgtatattgagaactacgggggaaaagccgtcagctgcccgttgacaagccggtttgagatcgacattgaagcggtaaggcaatcgatcactccacagacgaaag

SEQ ID NO: 13 - DNA, 1000000 bp, Bacillus subtilis
ggctgatcctcaatacaccgcataaccccacaggcactgttctcagccagaaaaatatagacgatttaggcgctttattaaaagaaatagaagagaagagcggccagacgatttatgtgctgtttgatgaaccgtacagtcaattaatctatgatgaagagctggcaaatccgtttcaatcgtaccatcgtgtgatattggccagctcattcagtaaagatctcggcatagccggggagcggctcgggtatatcggattggacagccgaatgccggatgcggaccttttgatcaacgcttttgtgtattgtaatcgaacgcttggatttgtgaatgcccctgtcatgatgcagcgggctgtggcacgaatggatgatttaagagtagacgcgagtgtttataaagagcgccgggatttaatggtagacattttaaaagaagccggttttgaatttgaaatgccaaagggaggtttctttgtttttccaaaatcgccgattgaagatgaagttgcattttgcgtgcatgccgcccaaaaatacaaattattaattgtgccgagcagcggttttggaatgagcgggcattttcgattatccttcagtgtgccgatcgagcagattaaaaactcacgggacattttcatttctttatataaagattttgcttaagaaggcaaagaaaagaaaacagttttcaaggctgttttctttttatatccacaaaatccttcctcttccaatccagacaggcgaagaattgacaagcaggcatgcagttaagtctttcttcatgataaaagtctaaaaattaaaaatcatttttggaatgagttgtgttacaataaaatatacaatttataatcaaactttgacttttggaggtggtaagatggggccctctgcttaggcaacaatacaccgcgtacctcaatgttaaggaaaaatgattatatcaggaggtgactccttatcctttgttgagaggatagggttaaatggacgatattgacagtctgattttaattggcgtgctcattgctttaaccgcgtttttcgttgcaagcgagtttgcgattgttagagtaaggagatccagaatagatcagcttatcacagaaggaaacaaacgggcgatactcgcaaggcgtgtcattacagatttggatgaatatttatccgcatcccagctaggcattacattgacatcaatcgggcttggcgtactgggtgagccggcctttgaacggctgctgcatccactgtttgaaccgctcggcttgccggactcggtttcacatgcagtctcttttgcagtcgcgtacggcttgatcacgttcctgcacgttgttgtaggtgaacttgccccgaaaacggtcgcgattcaaaaggcagaacagctgactttactgatagcgggccctttgcgtttattctatttgctcctgtttccgtttatttggatcctcaatggatcggcgcggcttttatgcgggatgttcggtttgaagcctgcgtcagaacatgatggttcccattctgaggaagaactcaggatgctgttatctgagagtttaaaaaacggagagattaatccgtctgaatataaatatgtgaataagatttttgaatttgataatcggatcgccaaagaaattatgataccgcggaaggaaatggctgctgtgtcaactgagatgacgatggccgagatgcttgaagtcatgctgaaggaaaaatacacgcgctggccagtcacagatggagacaaagacagtgtgatcggtttggtcaatacgaagcatttgttttctgatttgctgtttatgacagaagaagaacgaatgaagatgacgatccatccgtatgtgaggccggtcatcgaagtgattgaaacgatcccggttcatgatttgctgattaaaatgcagcgcgagcgcattcatatggcaatattgtcggatgaatacggaggaacctcgggacttgtgacgacagaggatattcttgaggaaattgtcggagagatcagagatgaatttgatgaagatgaacagccgctgatccaaaagcttggcgacggccattatgtgatggatggaaaggttcggatcgatcaggtgaacagccttcttggcgcatcgattcaagaagacgtcgatacgatcggcgggctgatattaaaagaaaacatcgatattgaggctggtgaatccattcgcatcggttcatattcgataaaggtgctgaagatggacggccgattaatcaagcaaatcgatataaaagaagaagccggcaacacaaccgggattacggcgcaccacaagctgctgctgcccgatcctgtgatgctgaacagtgcaaccttgagcgagaaataagctcaaggtttttttacattgtgattgtccagccgcaccaaaatgccaaaagcgatccgcaaagtgtcagggcgatgtacaagatgctttctattacacgtttggccataaggagttgaatagtttcaacgctgaaggtggaaaaggtcgtaaaggcgccaaaaaaccccgtgccgatgataagcgagaccgaagcatttgcaacgtgaagtcctgtaaatattccgagcccgagagctccgagaatattgactgtcagtatgccaatgggcaggctgagacctttggttttggcggttatgacattgccaagccagaagcgaagcattgcgccaagtccgccccctatgaaaatacccgctagtgtcatctttcctgcagcccctttctttgctgaatgcctgctatgcgccgtcccgcaaaaacaccaatcagtgcaaatatgatccctgatatcaatgaggctgccacatataaaagagccaatgagggttgtccttgcaaaagcatcactgtttccttagaaaacgtggacattgttgtgaagcctccgcaaaagccggtgcctaaaaaagccgacagcagaggccgttttgccccgatcagaaaaaatccggtcaaaatgcctaatagaaggctgcctgccgcattttccagccaggttgccgccgggaactgaccggtgtgtatccataagtttaatccgtatcggaggcaggcgccaagcgcgcctccgataaaaaccgcgctatatattttcatgtttgccatcctttatgatgaaatccgggtaatctgtaacgatgccgtccacgcccatggcttgtaattttgccgctgtcttttgattgttgacagtccatgcaaatatgtttaagccatttttatggatggagccgatcatcagacggttaagccgtgtgtgttttatattgacatagtttgcaaaagagcggaaggccttcatctgatttctggacagcatgccaaagttgggccttgtaatgaccgctgtcggaatcgaaggataaagctcgcggaacctttggacggagcggaactgaaaggattgaacaatattattgatagaaaaagaaaattgccctaatagctgtcccacctcttcttcaattccgacttgagacggatggccttttagttcaattaaaaggccgatttttttgtggtagcgcttgagcaccgcttccagggttggaatacgctctccttgaaaagcgggaccgtaccagcttcctgcatcgagtttttgcaattcctccaaggtaaaatccttaacaaagcccgatccgtttgttgttcggtcaaccctgtcatcgtgtatcacaacaatctgcctgtcttttgtaagctggacatccagttcgatcatatctgcattcattttcaccgcaaggtcaaatgcggcaatcgtattttccggagcgtagccggatgctccgcgatgggcaatgatgtacaagctaagtcagctcctcgtatgggcatttctgttattgtatcaaatccatatatgcaccgcgatacaaactggtgaattttttctgccatatcggaatggtccgggctgaggaatgcgtataactaaaaaaagacactcagcgtatcagaacacatttcgtcagaaaattaggtctttcgacatgttcacaacaaaatatgatcctttataatagcaaaaaaggaggcgagatcatgggaaaagggagaatcagagtggaggaaagaattaaagccgaaacggatgctgaaatgcaaaaagcaactctccttgatcagacacaaacgaaaaaaggtaagtgactgtccctattgaatctggctgatagatgaattgagaaatgaccccggcgtttcgccggggttttgtgctgcaaaagacatttaaatgaacatccttacgaatattttagtataataaacaattgattgggatagaggggagacagtcatgccggattatctgcagcagtattttacgcttgataacatcatacaaatcggcatcagcttggcgattttgctggtgtttcttatacttagaaaattattcacaagatatttctttaacctgctttttaatttgacaaaccggccgaaaacagaaatttttaaacaggtggttctggcgtttgataagccggccagatggttttttgttgcccttgggctgtttttagcgatccggtattcaccgtttttagatgagcaaatgccggtcatcagcaaaatataccgctcactgattgtggcgcttttgtgctggggtctttgtaatttgaccgcaacatcgtcgtttatcttccataaggtgaatcagcgcttcgagcttgacatggatgacattctggccccgtttttatccaaattgctccgttttgtgatcattgcgctcagtgtcagtgtgatcgctcaggaattcaattatgatgtaaacggatttgtagcgggccttggtcttggcggactggcttttgcgcttgccgcgaaggataccatcagcaacttcttcggcggtattatcattattactgaaaagccgtttacaattggtgactgggtggagacgtcgacagtaacaggatcagtcgaggatattacctttaggagcacgagattcagaacagcacagggggcgcttgtaacggtgccgaactctacgctgtcgatggaagcgatcacgaactggacaagaatgaccaaacgccagattacgttttccatccatgtgtcctacgctacgccgattgagaaccttgaacgctccattcattctctcagaacaatgctcttagagcatgagggcgttgataatgaaacaatcatggtcaactttgatacgtttgccgacagctactacaatttattttttaacttctatacaaaaacgacggtttgggctgaaaaccttaatattagagaggatatcaactataaaattattgagattttaggtgcagaaggtgtccagtttgcatatcccggccaaatggttgttgtcaagcaaaagcacgaaagtgacccattccaggtgaatctaaataaagaggaaaaggaacgggcttaaaagagagacttcgtctgacagaggcggagtctttttcatggtaaaataagagaaaaaggcggtgttgagttggaaacattcaaaagtattctacatgaagcacagcgaattgttgtgctgaccggagcgggaatgagcacagaatcagggattcccgactttcgttcagcagggggcatttgggcggaagatgcctcaagaatggaagcgatgagccttgattattttttaagtcatccgcgtctgttttggcccaaattcaaagaattgttccagatgaaaatgagcggcagctttgaaccgaatgaaggacacttgcttttagctgagctggagaagcaagggaagcaggtcgatattttcacgcaaaacattgacggtcttcataaaaaagcggggagcaggcatgtatacgaactgcatggttctatccagacagcagcttgtccggcatgcggcgcccgatatgatcttccccatttgctggagcgggaggtgccggagtgcacggcggccggaaacaatggggacatttgcggaacggtattaaaaaccgatgttgttctctttggcgacgccgtcatgcactttgacaccctttatgaaaagctggatcaagcagatcttttattggttatcggcacgtctctcgaagtggctccggctagatttgtgcctgaggatgcaagtctgattcccggcatgaagaaagtcatcataaaccttgaaccaacgtattgcgacagcttgtttgacatggtcatccatcaaaaaatcggtgagtttgcccgaagtttgggcataaaaaagtgagccgccttatgcgcctcacttttttattcatgaacaggaaccattgtgtcctctaacactccgaaggaatagcctttttcttttaatttattgattagtaccggcagcgcgtttacggtagcgggaagatcatgcatgagaatcacattcgggcggcctgaagagctgtgttccatattttcaagctgctctaacacggccgtcacatactgtgaatttcggtatttccagtccatgctgtcaatcgtccaatcccagtacacaaaaccgtctttctcaagattgcggatttgtgagggggttagtgacggtttgcttccgtagggcgttctgacaagagcggttttatatcctgtaatgtcctgcagtgtgtcacgcgcctcctgcatttcttttagcggagatgtcggtgtttgatagaacaatctgttattgtgggtaacgccatgtaaaccgagtgcgtggccttccttttctgctcttttcacagcctgcttgaattcgttcatccgcggtgacagcataaaaaacgtcgcttttacatcagcgcttttcagtacatcgagcaagcgggttgtaacggctgaagggccgtcgtcgaaggttaagtaaaccgttttatctcccatgttctgctttgtctgcagatgttttatcagcagatcgggggagtcgtttttcagcttaaggctttctttctcatctcgaagctggccgtttgttgtgacagtgacttcctttgctttcgttgaactgttggaataacccaaaatcaccataagcaaaagcagcacacataaaactgctaaacttgcaaatttaaaagcaagcgaaactgcagaaggagaagcctctcctctcgtttgtcgcataacaatctctccattggcataaaatctctacataatgctgtacagcaggcagcttatgaagatgccttatgtttacaacctatgtattaccagtcaagtatacaggaataaaactggaaagcacatagaaaatttgtcgaaatgtcagattttaaggaaaaaataaactcctttccgctatagatctcttgatctttctgtttttcggcttgtccaatatggtagaattagtgataatgacagcttgaatgacatcagggacatctcgaaaagggagggcttttatgaaggttttagtcaatggccggctgattgggcgcagtgaagcatcaatcgatttggaagatcgcggttatcagtttggtgacggcatctatgaagtgatcagggtgtacaaaggagtattgttcggcttacgtgagcatgcagagcgttttttcagaagtgctgctgaaatcggaatttcactgccattcagtatagaagatctcgagtgggacctgcaaaagcttgtacaggaaaatgcggtcagtgagggtgcggtatacattcagacaacaagaggtgtggccccgcgaaaacaccagtatgaagccggcctcgagccgcagactactgcttatacgtttacggtgaaaaaaccggagcaagagcaggcatacggagtggcggccattacagatgaggatcttcgctggttaagatgtgatatcaaaagtctgaatttactgtataatgtcatgacgaagcaaagggcctatgaagcgggagcatttgaagccattttacttagggacggcgttgttacggagggtacatcctctaacgtttatgcggttatcaacggcacggtgcgaacacatccggctaatcggctcattctcaatggaattacacggatgaatattttaggactgattgagaagaatgggatcaaactggatgagactcctgtcagtgaagaagagttgaaacaggcggaagagatctttatttcgtcaacgacggcagaaattattccggttgtgacgctcgatggacaatcggtcggaagcgggaaaccgggaccggtgaccaaacagcttcaggctgcttttcaagaaagcattcaacaggctgctagcatttcataaatgaacgaagaaaagagcccgctttatacagcggagctctttttattttttaacaaatccaatcaaaatggagatcatcggcgatatatagaggaagaacgtaaacgggatgtagtctatgactggaacaccaagtgcgctcgccataaatgcgccgctgacgccccaaggaatcaatgggttaattaatgttccgccgtcctctaatgaccttgtcagaaatttgcgctggatgttttgtttgtcatataaggatttaaatgattgtcctggtattaatatcgataaatactgttcaccggttgccaagttgacgccgatgcttgagcagacagttgctgcaactagacggccttttgagcggatgcctttcatgatgccttccaatagtgcagaaatcaatccgattttctccatcaatccgccgagtgcaaaagcaatcataatgagagagacagagcccatcatggattgcaatccgcctctgttgataattttagcggctgcctcattgtcagtttcgaaagttgtgccattttgcaaagctgtcataaacgcctgcaggctgctgtcgggtacaaaaatagcagtcaaaattcccgaggaaataattccggcagtcagaacggggattactgatacccgtttcattgccagcaaaacgactaagagcggagaaagaagggcccacggtgtcacgtttgcaacatcttttattccggttatgacctgctgaatattatcggttgaagcagcgtccgctgacactgatgaaccgagaaagtaaaacagaacgacagtgatgagcaaagctggaatggttgtgcccatcatatggcgaatgtgttcaaagatcggtatttcgcctattccggctgcaaagttggttgtgtccgacatcggcgacattttatccccaaaacaagcgccgcatatgactgcgcctgctgtccattcaagcggaacgccggccgcgctcgctacgccgatcagcgctaccccgattgtgcttacagttgtcaggcttgagccaacaagtgtgctgatgatcatacatgaaaacaaagcagtcaacagaaggtggcttggttcaataaaggatagggcataaactgtcacagtcggtattgcgccgctgtacatccaggcgccgattaagatgccgatcagcgctagaacaataatcggctgtacgccgtttttgatcccgtctacaatccctttttcaatactcttccaggaaaatccaaaccataaagctgctgctgaaagcatgacaacacttaaaaacagcgggatatgaggttctacatgaagcaagaataagcaagaaataataatgcataacatgaatataaataaaccgacggctaacggaaacgtcagctttttttgagaatccaaaataacaccccatatttatctttaatgcttttgtgcttttgggcacgaaagcattataacagaaaaaaacgaaaatctatgttttttcacaattatgaatataaaagaagtgagcacagggcgtgctcactttacaatcaggacgggtatatccgatttcgctgaaagcttttcacttacacttccgaatattagctttttcagcctgttttggtctctgcttccggttacgatcatatcggcagaaatgcggtttgcatgctcgataattgattcagccggatcgccttctaatatatcgatatctccatctgcctgctgttcattcagcatcattcttgcttcggcgatgacttcttccgtacggtcttcatagatcattggctcaggtgatgttacacccgatatcagcggatcaggaacacttgtcatgcctccgctgatatagcttgcctcagctgcgggtctgggtgggtcgatgacggtctgattgtctttcatatcatgtgaatgggcgacggtaatagcggcatttaaggttttagcaagatcaatggctgtctgaagcgctttcttactattttcacttccgtcaaacgcaacaatgatacggtcagcatggaacatccttctcaccctttcaaagcgtcttacaacactactacccgaatttgagcacaattaaccttttcctattcaagtaatgattgacaataaaaggttttgtttatatgatgataaaaagatgaaatcagaatggaaggagggtttgctatgccaaggaatttgcgtgtttatcaaacagtttcatattggcgcggcaaaccttttgttctgttttcgtgaacggttttttaggtcggaccgcgcgctgaaaagcgctgtgcgtaacatatcggttaaaaaaggcatggagctgacgcttcatgccttttttatatacaaaatctaaggaaagacaggtgtatgggatgtgaagacaaatacagaggcgagggctgttcatgccaaactggatgaaaaaagctgcaaggaaaaaatagaaggcggctgataaggagatggggatagatgttttcagttttgaaaaagcttggctggttttttaaggcgtactggctgcgctatacgattgcgattgtccttttattagcagtcaatgtcattgaaatgtttccgcctaagctcttggggaacgccatagatgatatgaaaacaggggcatttactgcggaagggctgctgttttatatcggtatcttttttgtgctgacggcggccgtgtatatcatgtcttatttttggatgcatcagctgtttggcggagcgaatctgatggagaaaattcttcgtacgaagctgatggggcatttgctgactatgtcgccgccgttttatgaaaaaaaccgaacaggcgatttaatggcacgagggacaaatgatcttcaggccgtcagtttaacgacaggatttggcatcttgacgttagtcgattctacgatgtttatgatgacgatctttttgacaatggggtttttgatcagctggaagctgacctttgccgccattatcccgcttccagtcatggcgattgcaatcagtctatatggaagtaaaattcatgagcggtttactgaggcccaaaacgcgttcggggcgctgaatgacagagtgctggaatctgtttcaggcgtgcgggtgattcgcgcgtatgttcaggaaacaaacgatgttcgccggtttaatgaaatgaccgctgatgtttatcagaaaaatatgaaagtggcttttattgattcactgtttgagccgacggtgaaactgcttgtcggcgcaagctatctgattgggctcggctacggagcgtttcttgtattccggaacgagctgacgcttggagagttagtgtcctttaacgtttatctcggcatgatgatttggccgatgtttgcaatcggtgaactcattaacgtgatgcagcgcggcaatgcgtcattagaccgggtaaatgaaactctttcttatgaatcggatgtgacagatccaaaacagcccgctgatcttaaagagcctggagatatcgttttcagtcatgtcagctttacatatccaagctcaacaagtgacaatcttcaggatatttcatttacggtgcgaaaagggcagactgtcgggattgcaggtaaaaccgggagcggaaaaacgacaattattaagcagcttttgcgccagtatcctccaggtgaagggagcattacattttcaggcgtaccgattcagcaaatccctcttgaccgtctccgcggatggatcggatatgtgccgcaggatcatttactgttttcacggactgtaaaagaaaatattttatacggaaaacaggatgcaactgataaagaggttcagcaagccattgccgaagcacattttgaaaaagatttgcacatgcttccgtccggtctggagacaatggtcggtgaaaaaggcgtggcactgtcaggcgggcagaaacaaagaatttcgattgcgagagcactcatggcgaatccggaaatcttgatcctggatgattcgctttccgctgtagatgccaaaacagaggctgcaattatcaagaacatcagagaaaaccgcaaaggaaaaacgacatttattttgacgcaccgattatccgcggtagagcacgctgacctgatccttgtgatggacggcggcgtcattgctgagagtggcacgcatcaagaactgctggccaataatgggtggtaccgggaacaatatgaaagacagcagctgttcactgcggaagaagggggagcaggggcatgaaaataggaaaaacgttatggagatatgcacttctttatcgaaaattgctgatcacagccgtccttttgctagctgttgccgtcggtgcagaactgactgggccctttattggcaaaaaaatgatagacgaccatatcctcggcattgagaaaacatggtatgaagctgcggaaaaagataaaaatgccgttcagtttcacggcgtctcatatgtcagagaggaccgattgcaggagcctgtttcaaaagcaaaagaagcgcatatttatcaagtgggaatggcattctattttgttaatcaggctgtcagcttcgacgggaatagaacggtttctgacgggaagctgacgatcacaaacggagacaagagccgggcatatgctgccgaaaagctgactaagcaggaacttttccagttctatcagccggaaataaagggaatggtgtttctgatctgcctgtatgggggcttgcttgtgttttcggtattctttcaatacggacagcattatctgctgcagatgagcgccaatcggattattcaaaagatgaggcaggacgtgttttcgcacatacagaaaatgccgattcgctattttgacaaccttccggccggaaaagtcgttgcgcggattaccaatgatacggaggctatcagggatttatatgtcacagtgctttcaacatttgtaacaagcggaatctatatgttcgggatattcacggctttgtttctgcttgatgtgaagcttgcgtttgtatgtctggcaattgtgccgattatctggctgtggtcagtcatataccggagatatgcgtcatattacaaccaaaaaatccgctcgatcaacagtgacattaacgcaaaaatgaatgagtcaattcaaggcatgaccattattcaggctttccgccatcaaaaggaaacaatgagagaatttgaggaattaaatgaatcacatttttatttccaaaacaggatgctgaatttaaactccttaatgtcccataatttggtcaatgtcatccgcaatcttgcgttcgtctgtctgatctggcattttggcggtgcgagcctgaatgcggcggggattgtttctatcggtgtgctgtacgcgtttgtcgattatttgaaccggttatttcagccgatcacaggcatcgtcaatcagttttcaaagctggagcttgcaagggtctccgccgggcgtgtttttgaactgcttgaagaaaagaatacggaagaagcgggtgaaccggcgaaggagcgcgcgctggggcgggttgaatttcgtgatgtgtcatttgcgtatcaagaaggtgaagaggtattaaagcatatttcctttactgcgcaaaaaggcgaaaccgtagcgctcgtcggccataccggatcaggaaaaagctcgattttgaatcttctgtttcgtttttatgatgcgcaaaaaggtgatgtcttaattgatggaaaaagcatttacaacatgtcaagacaggaactcagatcccatatgggtattgtgcttcaggacccgtacttattctcgggcacaatcggatctaacgtaagtctggatgacgaaagaatgactgaagaagaaataaaaaatgcactgcggcaagtcggtgctgagcctcttcttaagaagcttccgaagggcattaatgagcccgtgattgaaaaaggcagcacgctatcctctggagagcggcagttaatttctttcgctagagctttggcgtttgatcccgcgatcttgattttagatgaggcaacggcgcatattgatacagagacagaggccgtgatccagaaggcgcttgatgtcgtcaaacaaggacgcaccaccttcgtcatcgctcaccggctttcaacaatcagaaatgctgatcagattttggttcttgataaaggagaaattgttgagagagggaaccacgaggaactgatggcattagaaggccaatattatcaaatgtatgaactgcaaaagggacagaaacattccattgcataacgctcaaaaacccaaaacaatcgtgttttgggtttttggtttatgtagtcaataagccagtccgacacggtttccgacatactcacctgtaacgagctcacgatataaaaagtccgcagtatcgccgaccgaaatgcttgtgccgccctcaggcaaaacgttacgctccgtacgataaacgccggttgctgttccgtccgggaggtaagtggggcagatgattgtccagtctaatgatgattctttaagcatttcgtatacttttgcatgctccttggctgcgcgggtctgctttcgtttcgattcatttgtttcaaaccggtattttcccggttcatatcgggaatctaggatccctgcggtgccgatcgtaataagccgtttgatatgctgttcctccataacggagagaatgtgtgccatagcagttgacaaggtatcatcaccatctgtgcctagacagctgatcacgatttcagcattctccattatttttttcacatcttctaagcggcgggcgttccccatgacggttctgtcttttgaaaggggaagatcagcatgttgagatctgatcagagcgaaaatatcaaatctttcatctgctgcagcttgtgttaaaaaggcttgtccgacgcggccgctggctcctaataaagcgattttcattaaaaaacctcctcgcctttcattataaaaggatgttctcagtttgaacagcgcgggaaagaatacctgtacaaataaacagaacgatgggaaacatattcatgaatcatggatacacttacgaattgaaccagctcccaattcacaatggtgatgaatgacaccccgattccctccctttttttctaggatatgtggagcaggaaaaaagggtgacaaaataaagagagcgcggaaaccgcgccctctatagccatatattgaattgttattgaactctgccgcccatttgctgctgagcgaaagatactaaacgttttgtgatttctcctccgacagaaccgttagcgcgagaagttgtgtccgctccaaggttaacgccgaattcagaagcgatttcaagtttcatttgatcgatagcctgagctgcgccaggaactagtaagtcatttgaagagttttggttagccatgtgtaaaatctcctttttatttagtatggttgggttaactggagttgcaccaatctgtgaacccttctcgggtgtcactgccgcctcggcgtaacccaatgctttgccggcttgttactacgtattatgttaaaatggccggaaaatcatgcggagaattgtgtggtaaatcttgagaaataaaaaaagcttagccgtttaggctaagctagtcataaatatgaaaaagcatcagttcatgtatctcgtttgtaagagcaggctcgtcagcgcgggcgggaaacaagtctccccattcaatctcaccgctcttatgatagatgccttcataatgggtccctttataataaaatgaaattttccatccgggcagcttttcttttgggaacaaaggtttccagctgaaatgagaaatcattacggccacgctccttacatttggtatcaattgacctaaataaaaacggcttatgttcattgtatcattgtttcagaacatcattgaagaggcctaaatatgcagtttgtcccagctttggataaagataagcccgctttattaaaaaagcggacaggttacgaaggccacaatgcttccggagatgtgattgccttctcagataaatatgacgcgtattcaaaacttcttcgttttgtaagagaatcaacatgatgcaaatttggatgagaaaaaatgcttcggcccgggcgcgaattcgcttcaaacatccatactttaccgttctgatcaatgccaaaatcgaaaccaatctccccgataaatccctcgatatgatcatgaaggacatggcttgcagtcagtgccgctgcagaaagctttttaatgacctcaactctttcagcgggatcatcgtatacttccgcaagtgtctttacagtgccgccgttagaaagatgtgttgtaatgctgttctttccggaaatttttacggcgattgctgtcactgtccattttccttttctgtttttattggtatggacacggaaatccgctggtttgccttgaaattcgatgagatcaacaccttgctgaatgagaaagtcggacgggttgtgatgtttttgaaattctgcaaggaatgaggcggcatcggaataatcaattgatgtaaaagttttggcgtcattcgtatgctttaccgtcaggccgccatctgttcttgtcagctgataaatgccggtgccgagtgctccatttgccggtttgatatagacttttttgtatgcgccacagagctcatcaatcagctccacagacggtgtcagctcggatctaggcaaaaagggtgccgttctcggatctttttcgagcaattgatgaacgttccatttattgaaaaacgttttattaaaccatgggatctgatattcatcgatcagcctcttttttgtatgttgcaagagaagtgaatcttcaatttttcggttcggcaaacggtcataaacgacgttcggcaatggaacgatttttttctcccagccgttttccctgtaaaggaggccttcaatcgtgccttcctcccaattgatttggtgcgcgccaaaaacgaagcagtagcccccggcttgctcgtgtaacgtgacaagtttagaaaaaaagagggaacgatccttaaatggacgttcaagagatacagtaaaccctgccgtaaagatgccgactaacggcccgatatgcactgtatgatcatgaatcagtatatcagccctgcttcggtggggaagcaaaagctcatgaaacagattttcagagagaagcacggtttgttccagatgccgtctgtaagcaacgtggcatctgacaaccttcgttccgaatgcggcatgcaaaagtccgtctcgcttcagcgaagagggcagaaacagggtattttcactggttttgtctatgccgatcaaaaaccgtttaggattcacgcggaagaactcctttctggctttgctcagaaaacagatattggcagcgctttaggggacaagtgtacagctgttctttttgctcgggagagacacgcaggattgactttctgcctggtttggaattgatatctaaaatccaaattctcccgtccttagcaagacatatatcaagaccgagttcaaacaacggcccatagcgctcgtcaagataatacggaaccgattgggtaatcgaaaacacatcatctagtaagaccacttgctgttttttcggtatatcttcaaaccaggagtcaaatgtcagcgcatcagatccgcctgacaaattggccagcagcccgtgtttgtatccgcgtcttactgcctttccgactgtattccattcacctgcttcgtttttttccataaacaggcgaatatcacaagggtattgttccttatcttgaatgtttaagtaaggctgaagcaaatattgatgctgaagcacttttttgcaccatgttttaaaagaagtctggttggaaaacgtttttgtctgcttatcctttccgatgtgataagtagcagtgatgtttttcttgcccagcttcaaaagaatcacgcctctgcctcccgcgccaaatgccggtttaaggatgcaggctttttctttggataaaaaggagtgaatttgttcgtagcggctcacctttatcgtttcgggaatatagggattgattacagagtgctgctgcaaatcgtgaaggacggtccacttatcgggaagaccccgcccgataaattccgttttcggatattttttgagccactcaacgattggttttgctttttgggaatgtgaatccttgccgtaaaaacagcgatcataaatataatctggaatcgccatttcagtttcgttccatgtgctgctggccgaatgatagaccgatgctttgacacgcaaagtgtcaggtgaaatatcaaatggtgtaaaccggatgaaacgtatgccgaattcgggtgctcttttggccagttctgcggaataatccgcttcatgctggcgggataaggacataaaaccgagtgttatcatggtgagactcccccttttattcaaaagctgccggcgggtgtccgcagctttacactaaatacatgtaagacgaacgcagctgacggtattctactttacagaatacgattctccaccttgccctattccaaaagaacaagctgattttctaagaacaggaatttgtctcctcgtttgctaagtgattgcatgagcctctataatacgtataggtacataatctatatgaaaaaagctgaagcacagatggaggaagatgaataggaatgggtattgcaggaacctttatttttatgatcgtgatcggcgctgccattggagcggtgaccaatcatttagcaattcaaatgctgtttaggccgtataaagcgtactatttgtttgggaaacgagttccttttacgcccgggctgattccaagacggcgagatgaacttgcaaaacaaatgggactgatggtagtcaatcatctcttaacccctgaaggcattaaaaagcggctcgtctctgatgcagccaaaacgcaggctcttcgagtgggggaacagctgattcaaaagctgtcactttctgaagtgacagtaaaagaagcgcttgaaaaagccgggatgaagcgcccagaaaaagctgctgatgcatggatcagcagctggaccgatgataagctgaatgagcttttccgccaatacggggaccaatcgttaaaagagctggtgcctatagaggtgcaggaaaagcttgaggaaaaaattccgatgatttcaggatatatattgtcacggagtgtcagttattttgaaagtgatgaaggaaaaatccgtcttggcaatatgattgatgactttttaaaagagcgcggcatgcttggaagcatggtgcaaatgtttcttggcaattcaagccttgcggatcgcgtgctgccggagctgctgaaattcttgcgcaatgaggaaacaaataaattgctttctgatctcttaaaaaacgaatggggcaagctgagggagtatacgtttaatgaagcagatgaaaaatggaatgcaaaggcgctcattttcagtttgaaacgaagagtgctgcaagcattttcgactgcccctttcttcgacaatacgattggcacgcttaccgtccgctatgaatctgagctgacccagcaaatgctgccggcactgttagacaaattgcttgaagggatttcgtccaaccttgaaagtgtcttaaaacggttgcgtcttgaggaaatcgtcaaggagcaggtggatcagttcccggtggagcgtcttgaagaaatggtgctgtccatttcaaaaaaagaatttaaaatgattacctatttgggggccttctcggcggaattataggcgcgattcaagcattgtttgtcatccttttttaagaagaaatggtttttgattaatgaaaggagctccatagtctgttatagtggagtggtatgtcaaacggcaatgatgaaaggagctatttacaatggctgttaatttttatgatgtagcgtatgatctggaaaatgcattacgcgggagcgaagagttcacccgtttaaaaaacctttacgacgaagttaacgcagatgaatcagcgaagcgcatgttcgaaaacttccgtgatgtacagcttagactccagcaaaaacaaatggcaggagaagagattacacaagaagaagtgacgcaggctcaaaaaacagttgcgcttgtacagcagcacgaaaaaatttctcagctgatggaagcggagcagcgcatgagcatgctgattggtgaattgaacaaaatcattatgaagcctttagaagagctttacggcagtgttgaaggctaataagcaaaatcccttcttggataagaagggattttttattcattcagcaaacttggaaatccaatgaatcttttacctctccattgatgatcactgataatgtatgaattcctttgtaatgctttctggtggttaaatccttaaaggattggtttcttgtgtatgacttcgtttcgttttttcgtatagttgtttctgttattttaaatactttctgatgacgctggcctcttgcttttacaaaatcaattgcgtactcaattcttactttttgatccctgtctgaatgaatatagaaagaaaattcaaggctttcgccaataactatacgtttgggctggcctgttaaatcatgtagttgtatcgaatcagcattttcataaccaaaaagcgctaaggcctgtttatcacccttttttaataaggtccgataggcgtgtttgataatccagtctgtatggggatgtgttccgtaccattgatctgcgacttttctcagtaaatgaggatgcgtttttgatatatcattaaggttgttggccacgctttttcttacatataaggactcgtcctgcatcagcttctcaaggatcggcaatacgggggaagggtccgatttcaaagccggtatcgattttccccatggcaggcggggcctgctgccttcgctcgcaagtcttctcacgtgttcatttttatgctcagaccatgcaagcaattgtgcaaccatcttttcttgatctaacagcaaaaaaggccttacagcaaattctgaggtcgaatattgcgtaaagtattccaatgcctttattgattcttcccaatgcgctaacccgtactgttccacataatctggaaataaaattccgctgagtcctttaaaatgaggggctgtatcccgtaaaattgtgagcgcttcaacgtattgttttggcaaagtttcgtataaagaaactgtcacgcggcgcatccgctcttttaaagtgagttcaggccagtcctccagccgtaatgtatcctcgaatctgtctttgttaaaatcaggataggatgaccttacatgatggatcaactgagatatcagttcttcattatatatttcttttaaatcagccatataaacaccgctttttcgtttattatttatattgtatgggaatgtacgttctggatcaagtgtatagtcctaaaaattaacaactgatcctaccacggatatacaaaagttggttactttttttagttaaaaaaacccttgtcatcggaaaagaaaactgagataataacattgaaagcgcctacacttacctatttcaaatggatacggtcgcatatcatgccgttatatagaggggataagcaacagagagtaagtgttcggagcgcatcattggtcaaacaaggggttcctgatacatgatttttcgtaaatcgaaataacgatattagggagaatggctgcttcgatcgtatcctatcaacaagccatacataaagtctgctgagccaggctttttttgctttaagaaaaggttgttctaaacacagagacagggtcatatcctatacacaagtacagtcatcaaggagggggacatctctgtgtcaaaacaattgcttgccttaaatatagatggagcgctgcttcggtcgaacgggaagattcatcaggcaacgaaagacgcgattgaatatgtaaagaaaaaagggatttacgtcacacttgtgaccaaccgtcattttcgctcagcacagaaaatagcgaaatcgctaaagcttgatgccaagctgatcacccatagcggggcatatatcgctgagaaaattgacgccccgttttttgaaaaaagaatttctgatgatcatacctttaacattgttcaagtgctggagagctatcaatgtaatattcggcttcttcacgaaaagtattccatcggaaacaagaaaaaggtgaattcgaatttattggggaaagcactcattcatccgtctgacccgatcttttatccagtccagttcgttgaatcattaagcgatctcctcatggatgagccggtgagtgcacccgtcatcgaggtgtacacggagcacgacattcagcatgacattacagaaacgattacaaaagccttccctgcagtggatgtgattcgcgtaaacgatgagaagctgaatatcgtcccgaaaggtgtctcgaaggaagcgggtttggccctcgtcgcttcagagctgggcctgagtatggatgatgtcgtggccattgggcatcagtatgacgatctgccgatgatcgaacttgccggtcttggggtagcgatggggaatgccgttccggaaattaagagaaaggcagattgggttacaaggtccaatgacgagcaaggtgtcgcttatatgatgaaggaatatttccgaatgcagcagcgaaaaggatttcttgataagttccacatgaaacgtgtgtaaaaaagccgctcgcaccctgacaggtgcggcggcttttttgccggattgattttagcagtttatttctgtacactaaagaaagttttgaatctgataaattaggtgatgaagttgcaaattaaaatagaaggcatacatgatgaccgcctgcatcggcctctgcaaaatattgcaaatttgttttatgaagagtgcgagcttgcgtatggcggagaggagcccgcagattttgtcatttctttagcgttgtcacaaacggatgagcatgtgacggtttcgggagaagtgaagggaactggcataaaggaacagcatacaaaattcttttctcccggcatgaatgaaaaagaagcttttaagcaagtgaaaaacacaatttcttatgtgtatctcaatcttcttcaggcgcatacgggcattacgcagaagtggggaatcctcacaggaatccggcccacaaagctgcttcataaaaaactgcaaagcggaatgtccaaggagcaagcgcatgctgagttgaaaaaagactatttaattcatgatgaaaaaatcatgctaatgcaggaaattgttgaccgtcagctggcggcagttccggatttgtaccgagtaaaggatgaagtcagcatttatatcggcattccgttctgcccgacaaaatgcgcgtattgcacattccctgcgtacgctatccaaggacaggcgggcagagtcggctcattcctatggggactgcattacgaaatgcagaaaatcggtgaatggctgaaggagcatgatgttaaggttacaaccatttactttggcggcgggacgccgacaagcattacagcggaggagatggatctgctgtatgaagaaatggtccgctccttcccggatgtgaaaaacattcgtgagattacggtggaggccggtcgtcctgacacgattacagaagaaaaactcgccgttttaaacaaatatgacattgatcggatcagcatcaatccgcaatcctacgaaaacgaaacgctaaaggcgatcgggcggcaccatacggttgaagagaccattgagaaatatcatctgtcacgccagcatggcatgaataatatcaacatggacttgattattggtttgcctggggaaggcgtgaaggagttcaggcacagtctttcagaaacagaaaaactgatgccggaatcccttaccgttcatactctttcatttaaacgggcgtcagaaatgacgagaaacaagcataagtacaaagttgccggcagggaagaggtttctcaaatgatggaagacgcggtagcctggacgaaagagcatgggtacgtgccttattatttataccgccagaaaaacattcttggaaaccttgaaaacgtcggatactctttgccgggacaagaaagcatctacaacattatgattatggaagaggtgcagacgattattggcatcggctgcggcgctgctagtaaatttattgatcgggatacagggaaaattacgcattttgcgaatccgaaagatccgaaatcgtacaatgagcgcttcgagcactacacggacgaaaaaatcaaatatttagagcagatttttgaaaaaacgacaaagcagcactgatcacagtgctgctttttttatccctgtttttttgcgggctgaacctcaggcttccatttaaataccttgttaagcaagcggtaaattcgttttgattcctttgtgacaagcggtcccaaaatcgccagaatgaggacatataatgcggcaaacggctttaatgtggccgacagtccgccggctatcccgagattcgcaacgataatcgaaaattctccccgcgatacgatcgtcagcccgatattcgatgaagccttatgagaaagccctgcgcgtcgtcctgccaccattccggcgataaaatttcccagaatggtcaaaatcactgcacccaacgcaagccaaaccgcttcacctagcgaaaacggatcgatactgaggccgaagctgaaaaagaacatcgcaccgaagaagtcgcgaaacggaacaacgaggtgttcaatcctatcggaatgctctgtttctgaaaagaccaaaccgagcagcagcgcgccgattgcttctgctacatgaatcgtctcggaaaacccggcgataaaaaagagcgctgcgaaaatgacgataataaacacttcgtttgagcgaatgtccaacagtttgttcaacagcggcgggagttttcttgctgcgataaaaaacagcagcatataaccgaaggcgatcaaaatggacaagagtgcactccctacggatgtcgcatcacctagtataaggccggaaacaacggacagatatacggcaaggaaaatatcttcaaacatgatgatgccgagaatcaattcggtttccggattggcggttctttttaaatcaacgagcacttttgcgacaatcgcacttgacgagattgtgatgacgcctgcgaggatgaggacttccagaaaggaaaatccggtgataaacccgtaaagcagtccgaggctgaagttaatcaaaatataaatcgtcccgccgaccgcgattgattttcctgatttgattaacttcccgacagagaattcgagtccgagatagaagaggaggaacagtacgcccattcgcccgaaaaactcgatgatttcactgctttgaataaatgttagatcaataatccccattttcggcgcgtgcggtccaacaagcattcccagcacaatcagaaacggaataatcgaaaatttaattttattggcgatcacactggcgattgccacaagcacaagtgcagttccgacttcaaatacaagatggtccatcggggctcacacgccctctccagaaagaaaatcgtgaatcagtttcttcagatgctttctctcacctgagaggacaagggtgtcattttcttcaataatcgaatccgctccgggatttaggagcttttcctggttgtgtttgataatcgcaataacagtgacatcgtaattctggcgaacatcaagctcaccgagtgtgcgtccgatcgatttggcgcctttttcgaccttaaaccattcaataataagatcgctgaaggccatttcgatggactccagagcttgcggtttatagaccatgcccccgagaatagctgcaatttgccttgcttcagaatcatccaatgaaatatttgaaagaagctcatccgggtcccggtcattaaaccggtaaatttcccttcttccgtcatcatgaatgataatcgtcattttttcgtggcttcttgtttcgatttcaaactttttgccgatgcccggcagatcgttttctttaatattcaatgaaaatccctccgaatgtagtgttggcagtatggggtgagttacaaataaaacttgagcaaattatattcggaggtaattagactggtatttgacagggacggcacaagccttttccagcctgtttatcagcggttcgtcaagtggtttgacagagagatgcctgacagactgtgccagcgggctgtactctttgatcagctcagccgggtgaatgctgcccggcgacggcgtttttgccgattgtgtttcctgcggatatgaggacataggcacatagctgtcagtgcttgcttcaaactgggaaggcagaaccacgtccgaagggggaaagtacaccataaataaacttaacagaaaactgatcagcaatttatccatgtcctttcctcccttctcatcaagatatcccttctttttcactatataaaactttatgtttccattcaaacaatatgcatttttcagtatctattgaccttgaaaaataaaaaggtttatttggggatggcggggaatgtataggagaaagaaaaaagtaagcgcatacatggaggtgcttttaatggagtttgttcaatatgcatgtaatggggccgttgcagagattatcctgaatcggcctgatgcccatcacgccctgaatgaacagatgctgtctgaattgaaggaggcagtcgaaatggcggctgcaagcgaggcgctcatcgttctcctgagaggaagcgggaaaggcttttcggccggcggtgatatcaggatgatgacgtcagagcatgaccctgaccaatttaaacggctgatggatacgattgaggctgtcaccctgaatttatatcagatgaagaaagtgacaattgcagccattcatggtgctgctgcgggactgggcctgagtttggcgctttgtacggacattgtgctcgctgaaaaaaacgccgttctcgcgatgaattttatcggcattgggcttgttccggacggcggaggacattatttgctgaagaaaagaatcggtgaagcaaaagcgaaaaaactgatttggagcggaaaaaaactatctgcctcggaagctgccgatatggggcttcttgatgggacatttgccggagaccctgccgaaggcgcaagacccattatcgaaaccctgttggcctcccctcttttggcgatgatcgaaacgaaaggtatttttcaaagcctccaaattgaagaactgaaaaaagtgctatcccttgagcgcagcgcccaagagagaatgagaaggaccaaggatcaccaagaaggaatccgtgcctttttagaaaaacgggagccgaagtttcaagcgtaacagatcagccggaaagctgatcatctgtgaaacaaaatcagctttccggctgcattgactaaacgatgagtatgactatgaagctctttttcttttaagagggcttcaccatgcgtttttgccgcttcttcatgttctgcctcgaattgctcgtttaccagcgtgttccccgaaggatcaaatacggtaaggaaataatcagccatcaggtttctcctccattttaaggtttatcagtctttcttcatttatattctaaaaaggaaatcaaaatcctttattatgctttatccaaaattagtatataatgggtcagggaaggaggagattcagtgcttacaattgatcacgtaacgaagacatttggagattataaagccgttgacggattggacttagatattccggaacagcaaatgttcggtctattaggcgcaaacggagcgggaaaaacaacaacgtttcgcatgatcctaggattattaagcattacggagggctcaatcagctggaagggccgtcctgtgaattatcatatcagcaacaaaatcggttatttgccggaagagcggggcctttatccgaaaatgaaggtaagggatcagctcgtctatcttgccagattaaaagggatggagaagcgagaggctgtaaaagagctcgggacatggcttgaacgcttcaatattacagattacgagaataagaaggtggaagagctttcgaaggggaatcagcagaaaatccaattcatttcggcagttttgcataagccggagctcctgattcttgatgaaccattcagcggcttggaccctgtcaatgttgagctgctaaaagaggccgtgatctcgctgaaaaacagcggtgtttctattttattttcaagccatcggatggaacatgtggaggagctttgtgagaacctttgcatattgcagaaaggaaaaccggttgtacaaggcaagctgaaggagatcaagcgttctttcggtaaaaagaatgttaccattcactccgatgacgatctgcgctttttgcagtcccatgaaggcattcttcaatggaaggaaacggcagacggcgtcaagctgcagattgccaatgaagacatttctcaagagatttttgcgatgctacagggaaaagggtttatcagaaagtttgagcttgaagagccgtcactgcatgatatttttatagaaaaggtgggggccgtctatgaataaattttggatcatgctttctcatacatacaaaaataagattatggcaaaatcctttattatttcgactgtcatcacggtgctgcttgttttagttgtaacgaatctggagtcgatcatttctttgtttcaaggtgacgatgcgaaagaaaaaatcgccgttgttgatgaaacaaacgaattatatccggttttttcaaagcagctgaaagcggtggatactgacggcgatcttgatgtgaaactgtcgaagcaatcggaggatgaggtcacaaagcaagtcaaagatgaatcactcgatggcatgctcatcatcaaacgagatgaaaaagggaccatttcaggaacatataaagcgttaacgatttctgatgaaagcacgtatcaaacactgcagcaggcgctgacgcaaaccaaaacagctgtcggaacagcggagctcggcgtgtcgcaggaaacgatcagcagcctttatgcgcctgttactgtggggcagaaggcgctgaaagaaggggcaaagtctgaggaagagcttggccagacggtagggcttgtttacattatgctgttcgtcatttatttctcggtgattatgtatgccagcatgatagcgatggaggtcgcaaccgaaaaatcttcgcgagttatggaaatcctgatctcaagtatgccgccgatccagcaaatgtttgcaaagctgcttggtatcgggcttgtcgggatcacacagcttgctattattataggagccggctctctgtcgcttaagctgaaccaaaagagcgaaacggcttcatctgtcggcggattccttaatttgaccaacgtatctgcaaccactgtcatctatgctgtcattttctttttgctcggatactttttgtacgcgacacttgccgcgtttcttggcagtgtcgtcagcagaatagaggacgtgcagcaaacgatcacgccgatgacgcttttggttgtcgccggttttatgatcgcgatgttcggtttgaatgcgcctgacgcaggatttattacggtaacttcgtttattccgttctttacgccaatgattatgttcctgcgcgtcggcatgcttgatattccgttctggcaggcggctgtcggaatcggaatcacactgctcaccattgtcatactggccgttatcggcgccagaatttataaaggcggtgtattaatttacggcaattcaagcgcgttcaaagcgatcaaacaagcgctacgtttagcgaaaaactgattggaaaacagcctggggattctcaggctgtttcttttttgacagaacgtgcattcgcaagaattcggtgctaaaataagggtacttcatcctggaaaggagcagaatgttgactgatctaacctttattcatgcggcagatcttcatcttgacagcccgttttacgggatatcgcacctgccggagccgatttttgcccggattaaagaaagcacgtttgcaagcgtgagacatatgatagacgccgcagtgagagagcacgttgatttcattttgctggcgggagatctgtttgatgaagccaatcgaagcttaaaggctcagctctttttgaaaaaacagtttgaaagactcagagagtgcggaatttcggtatatgtcatctttgggaatcacgatcatcttggcggggagtggacgccgattgaatggcctgagaatgtccatattttttcgtccgctgttccagaagaaaaatcatttttaaaagaaggcaggcgcatagcaagcatttacggcttcagctatcaagctagagcagtgacggaaaaccaagccgcccgctatcggagatcaactgacgcaccgtttcatatcggcatgctccacggcacgctctcaggatctgaaggacacgatccgtattgcccgtttacccatgacgatctcgtgaaaagcgggatggattattgggcgcttggccatatacataaacgccaggttctatctgcagagcatccggcagtcatttacccgggaaacacgcaagcacgccatatgaaggagacgggagataaaggctattatctcgttcatgtgacaaacggagatatatcttatgaatttcagagagcgcatgatgtcctgtgggaaaaagcggcggttgatgtgacggaggcaaataatatgaccgctctcttccaaatggtggaggacacgttttcgaagctgcggaaaaaggggagccctgtttgtgtaaggcttgttttacaagggacggcgccggaatggctgctggaggcgccaaaaggcaccttggatgagtttcttgaagctcttcaggaacaagaagcggaagaggaacatttcgtttggcctcttggattggacgatgagacagaaaacgaagcaaacctaacaaaccttgatcctttttttggcggtttatttgaagacattgatcgcagcgatctgtcagacgtgctggaagggcttgagcggcatccagtgtatagaaggcacgcggaccggtttagccaagaggaggtaaaggaaataaaagagcaggcacagatattattgaaaagacagcttaaggtgcttgatacatgaggcggtgacagctttgcgaattatatctttacatatctaccaatacggaaaattttccaatcggacctttgacttttccgcctctcctgtccaagtcatctacggattaaatgaggcaggaaaaacgacgatgatgtcattcattgaaagcatgctgttcggttttccgaaaacgaaaaagtatgaaccgaaaacaggcggtgtctacggcggtgttcttgaagctgaacatcctgagtatggggtgctgaagatcgaacggacgaaagggactgccgaaaaactaagcgtgtacacagaaaagggcgaagtaaagcagggagatgttttaaagcagctgttccagggcacagacaggtcgttgtacaaagccatatattcgttcgacgtattcgggctgcaggaaattcacgcctttaatcgggacaagataggggaatttttgctcttttccagcttgtttggtgctgaagccgtatcaaagcttgattcaaggctgacgaaggaaagcgaaaggctctataaaccaaatgggcgaaaccctcaattgaatcaggagctggaaacgcttaagcagctggcagttaagctaaaacaggctgaagcagaggaagcgggctatcatcagcttctcgaggaaaaacgaacgcttgaagcccgccttgcagccgcggaaaccgaattgaaagagacggcgggacatatccgaatgattgagggagcgattgagcgaaagccgctgctaaatgaaaaagcgacactcgaacaggtgattgcagaatttccggaacacgcaggacaatttcctgctgacggactgcatcagctggaaaaatatgaatcccatcttcacccgaaatcagcacagcttgaggcgcttcgggtgaagatggcggagttggacaaacagaggcaaaagcttatccccgataaagaactattggcgaaagaaacgctgatacaagagctttcggcagcgtttcatatgtaccaatcctggggagaacagctggcagccattcaggcacagctgcgccagacgtctgcgcagacagcggcagggctggaacagctcaataaaacggatgaaaatgagctcctgaatatgaacacctcatatgattatgaatggcagcttcagcaagcggtgcagcaatatgtacaggcaagagacagaaaacggcagcttgacgagacgtttgaacttgcccggcaagagctggaagacgcggaaaaggccgttcgtgccgcttcgtccgcgattcttgaaaacagccaaagaaaagataaagaagcagctcttagagcatatgatgaaacacaggggcagcaccaagagcaagcgaagctcagagaacagctaacgttttttgaaagacagcaggctaaacagaaaaagactgtcattgcagctggtatgttgttcatcgttctcttttctctgctgcagcaatggattcccgccataagtttcggcgctgcacttattgtgtattggcttgtttcaggaaagtcgtcttctcgaaacagccgagagacaagacagcccatgacggatatttcaccagcagaagctgaaatgcttagagaagcgttatgggaggatgaccgcaataagcagcaccttctcacacagcgtgcagcgctccagcaaaaagaggcggcgtatgaaagggtcatccagcagtttgaacagtgggaagccgaaatggcgccgtcctttacacaggttgagcgttttatgaatgagctcggatttaaggaagatccatcatttttgcttgatgcatacagcttaatgaaggatgttaaaaaagaagtgaagaaaaagcatgagctgaccatagaagcaggcaggctgaaaaagcaccggagaacattcgaagaacgcgtcagtatgcttcttcccgtgaatcagagtcaggatatctccatttcggacgcccttcacacattgcggaaaaacattgaacgtgaaaaagaaattgagaagcaaaaaaaggaaattgaaacagatattcattatacaaaggaacagatgcttgaacttgagcaagaaatacagtatttccacgcacagattgaacagttatttgccgcggctgctgcaaaagacagagatgcgttttttgccatagccgacatcagcaggcaattgaagggtacggagaacaagcttcatcacgtaaacgcacagcttcaaggcgggtacccggaggaacttgaactggcggattccaatacgctttctgaattgaaagataagcaatttgttgagaatgaaagaaaagagcggctgactgaggagatcgagcagctccgcagccaaatcgcactgctctcagtcaaacaggaacaattagaggcttcgggaatggtctcagacctcaagcttcaaaccgaaatgcaaaaagaacgtgtgaaagaaacggctaaaaaatgggcctccatacaaatggtcagacaggtgatcagaaacaaattggagcggcataaaaaaatcgagcttccgcgccttctagagacggcaggagaatttttccgccctctgactgacggaaactaccaaaccatttatttttccgaaacggatgattcgatcatggttatgcatcgcgatggaactgtctatcatgcggaagagctgtcacaagggacatgtgaacagctgtatacagcgatccgatttgctttggccgttacgcgccagggtgggtcaaagcttccgttccagcttgacgacagttttgttcattttgatcaggaaaggctgaaacgtgtattacatgttctgtatgatttatctgaaggcggtaggcagattttgtattttacatgccatgagcacgtaaaagatgcatttcatagcagccaaatcatccatttggtgtcataaaagaggttctatagctgaaaatcggtatgtgatatactggtattatgtaagatacggagggagctttaatagaatggctaaagggattatgctacatgaggttggcgaacaggtggaccagtatctattgattaaatcctcgacgaaagggattgcaagcaatggaaaaccgtttttgacgctgatgctgcaagaccagtcaggcgatattgaagcgaagctgtgggatgccaagcaaagtgatgaagtgacctatgcgccacagacgattgtcaaggtcgtcggcgatgttcaccattatcgcggacgcacccagctgaagctgagaaatatcagaccggtaagcgagcaagaaaacgtcaatattgatgattttttagaaaccgcgccgattccgaaaaatgaaatgatggacaccatcactcaatatatatttgaaatgaaaaatccgaatatccagcgaatcacaaggtttttggttaaaaaacacgaagctgagtttatggattatccggcggctacgaaaaaccaccatgagtttgtctcaggtttggcgtatcatgttgtctctatgctgaacctggcgaaagcaatagcagatttatatccgtctcttgatcgtgatctgctttacgccggtgttatcctgcatgatcttggaaaagtgaaggagctgtccggccctgtttccacttcgtacacggttgaaggcaatttgctcggccatatttcaatcatggtgacagagctttcaaaagcggctgaggagcttcaaatcgattctgaagaggtgttaattcttcagcatttgattttgagtcaccatggcaaagcagaatggggcagcccgaaaccgccgatggtgaaagaagcggaaattcttcactatatagacaatctggatgcaaaaatgaatatgatggacagagcgcttgagcgcgtgaagcctggcgagtatactgaacgtgtatttgcactggaaaaccgttccttttataaaccgacatttcataaataacttaaaaaggactgatgctgacatattcagctcagttctttttgatgcgtctttcccgcacataactcgtctcattcccgcatatggttaagaataaagaatctatgcaaagggggaggagcccgtgttattttttccgtggtgggtgtatctttgtattgtaggcattattttcagcgcatataaacttgtgacggcagccaaagaggaagaaaaagtagaccaggcttttattgaaaaagaagggcagatttatatggagaggatggaaaaggagcgagaacgccgcagttctcagcagcatgaagaagaaaatcaaaaccattccatcgcataaaaaaagctgtgcggctcaatgagcctgcacagcttttttattatttagaattgcttgaagatgaagaagtgctgttacttgttgaagatgtattaaatgtgtctttcagatctttatcttttacttcgatgtcagccttcttcatgactttttgaacagcttcctgaacggcattgctgtcatttagtttttgttcaagcacttcagatttcagttcttttttcatatcttcatattttccgcgttcttcagtctttttgatgatatggtagccaaattgtgttttcacaggattgctgacttcatttgttttcaacttgaatgcagcttttctgaatgtggaatccagttgttcgttatcttttgaaatccagccaagttcgccaccgtttgtagcagtggagtctgttgagtattctttcgcaagatcttcaaacttttcgccttttttcagctttttctctacttcttcagctgtctttttatcagcgacaacgatatggcttgcgcgaatctggccttttaagccttcccagtattctttaatttcatcatctgtaactttgatgttatctttagccgctttttgtgtcagcaattcatattttacttgttctttcaggtaatctttgccatattgcttttcgagggcagtatattgatcgccaagctgcgttttatattctttcagcttgttgtcaatttctttatccgaaactttatacttcttgtccaatactttttcttgcactagctgtgtcagtacgcttgcgccagctgttttcttcatgtttgtgtaaagctcgccttttgtgacatcgcctgcgtctgtttttgcgataacttctttgtcgccgctgctgcaagcactgagagcgaggatgcttgtagcagtgatagctgctattgcgattttcttcattgttttcaaacactcctaatcattccaaattaaattacctatgcgtatcataacatattgtggctttctgtaaaaagattttaaataaagggcattcgtctagtcaaacttttgctgatgacatacttatatattgatcaagaaaaggaggtatgtaacatgagcggaggatactctaacggattcgcgttgctcgtagtactgttcattttgcttatcatcgtaggtgcagcttacatctactaagcagcccgaggatcgcttgcaacataagcgatcctttattttcactagcgcctaatcgtttcaaacatgaattgcataacatgtaattggtaaataaagcttattacaggaggtgctttttaagatgggtgaagtatttgcaggcggattcgctttattggttgtgttatttattttattgattatcatcggcgcttcttggctgtactaatcaacataaaaaagcatagctgcttaatcagcagctatgctttctttcgtatttacactgtaaaggagatctccacaaacgaagagatcagtaaaattaatatagatacattaataaatcggaataccttatcttgccgctcttcaggaatctctctgacaaggcataatgtattggtgagcctgtttatgaaatataaaataaacacggcagccacgataaaatagaataaaatgatgggagattccccctctctctgaactgtcccatattacattaccaaatatttattaaaaaagatagaatgcaaattgaaaaatcgccaccagcaccagggtttgactacttttcaacaagaatatccaagccgtcagcttcctgatcaataaaagcggttttcggtgcttttatcagcttgagagccagcaggaaatcaggcagacagtagccggcgtgaatgcccgagatcatgcagaaataatgagcgtgattcggaaatgccagtgctgcgtaaaacaataccggtgtaatcagcaagaacgggctgacgagtgaaatcagcattgttgtttttggtatacgtttccatgtgcgcatgcgcaatatggaaaactttttttctatttttctttttttgcagatgattggcaggacatggatgactttatgtgcaaataaaataacgacgagcaaaccgccgaataaagatacatattcatcgcttaagcttgtgccaggccgcagcagctcaaaagctaaaaaggtagatataaaaaccaaaatcataaaacatacagcagttaatattatgcgaacggcgccataatccttcatgagatttatggtcttccagcaattcatcaaagtcatccttccatacatcttgaatagaatctcaaaataatttactcctcccaagagaaaaaatcaatgcttttttaagaaaaaatatcatccggcaggtatttttttgaaacaagcaaacaaactgcgaaatatggggttagaactttcttctcagtgaattatcagctaaaataagattaaagatagaaagaagtggtgtggatggattcgatggatcatcgcattgagcgattagaatattacatacaattattagtgaaaacagtagatatggacaggtaccccttctatgcgcttctcattgataaagggctgagcaaggaagaaggggaagcggttatgaggatatgcgacgaattgtcggaagagctggcaacacaaaaagcgcaaggatttgtaacctttgataagctccttgcgctttttgccggacagctgaatgaaaaattagatgttcatgaaacgatttttgccctgtatgagcaggggctttatcaagagctgatggaagtctttatcgacatcatgaagcattttgattaactgtttacaggttcaagctcttcagccggttcatccgccgcactgtcctttgcttttttcttcagttttccgtttacgctttcaaagtcattgtcaatattggtgagtgacgtttcgaaaatttccataaaatcatcgccgtagatatggcgtatcatacacatcatttctgccacttcaggaaattttccgaataaatgatacaaaggctgtgaccctttaaaaacagcgttgcgtgtcggatcaaattcctcaagcaagctccagaatacctcggtaccttcctcagtcaattggacatatgtgttccgtttatcattcagccgtttggagaaccttaaatatccccgttcttccagcttttttgaaaagttgaatgcggttgatacgtgcatgaccccgaacttcgcgatttcagaaatggaagctccattcaattgatacgcaatccataaaatatgatgctcattaatattcaggtcatacggtttgagccattgctgccaatccttctcgatcgatttccaaagagctttgctaagctgagccattttctgggtgaaaaccagagcttctttcacatcatagggcggttccactcgattcattacgtcacctgcttctctttttctttttctctattatgccaataaaataaagattaataaagatgaaaatgtaagaattttttaataaattcacaaaccattgcgacgaaagggtttttcggccaaaaaaaaatacgggtccaattttggcccgcatttttttcttttgaataggatattagttttgtaaggttttctccagctgtctgattttctcttcgatatcggcaatttctttttgcagatcctgctggtgaggcttgatctcttcctgccattttttaattgacgtttggagctcgccgcccacgtctttaataacatccgtgctttcttttgccgctttgatcagctggtcttttaatgcaagcccgtctgactttaagcgtttgattgtttcttcaaaagaatcataattggttttcattttttcacgcagctgctttcctgaggaaggtgcagtaagaagaaccgctgctcctccgatgatgccgcctacgaatagtcctgttaatagagaacgtccgctcgccattacaatcaccccgtctttttcttcaaaataggattcattcagcatttttcatttttgttgaaagcctgaacttctatacatagcttgctttattttagcatattttttaagtgaaaaggagggagaaggttgtctgtctttttgattgtattatcctgcatcacccttgccttcgcttcaggcgctgtttactatatcaaacttctcagccaggctgcttcttatccgcccaagagggttatccggcagaaagcgcttgtttgttcaaccggaaccgcctttacactatgtcttatctttttcacaaaactcctcgcttaaaacatgctgacatgctgcgggcgctctgttcaaaaaaacctctcccggaagcggaagaggttttgtgtgacaattatttagcagcttccataaagcttgaacgccttaaaatggtttgcacaatcggataaataatgatcattgagattgtattcagcacagcggccggcagaacaacagccgcgaacaatgcggcgaaaccgcccggtaaaccgacgatcaataaagctgacgatagaaacacaattcctgataagatggtcccgatcactgtcagcacagcggctgcacctgttttccggctctttctgaacaagagaaacagggagaagaacagaaacgctgatacgggtttatcaatgatgttagggatctgtccggctggaaacgcggttgtaagcgcggaaatgattccggtcacgatcccgatgacgagtacattttgcacccgcgggaacagcagaatgcccatgaacatcatgatcagcatcatatctggtttcatgccgcctaaaaagggcggaataatggaatgaagcgctgcgccgatagcggcaaacagagccataatgactaactcttttgttttcatatctatgctctcctctgctaagcttttgccctccaataatatgctcatcatttattgcgaaggctttacagaatgtgttatgcaaacagtataccaaacgaacggtttgcatagccagactttttactcattttcctgctggaatttcttcatgaacgcagctaatttttcacagtcttcgagagagaccgcgttataaatagaagcgcggcagcctcccaccgaacggtgtccgccaaggccgatcatcttcgcatcttttgctttctggacgaatgttttcgttaattcgtcatcccgaagcgtgaaggtgacattcatgcgtgagcggctgtcttttctggcatgtcctttatagaagccgttgctttcatcaatacagctgtagagaacctgcgctttttgttcattgcgctgttcagcagtttccacaccgccgttttccttgagccactccagaacaaggctcagcatataaatcgcaaatgtcggcggagtgttgtagagtgaatccgctttgacatgcgtggaatatttcaggatttttgggacgttcgcattttcatttttcagccagttttttttcatgatgactacagtcacgccggaagggccgaggttcttttgggcgcctccgtagatcacgtcaaatttagacacatcgatttttctgcttaaaatatcgctggacatgtcggctacgagcggaattggagaattcggaaactcctgccactgagtgccgaaaattgtattgttggatgtgatatgtaaatatgcgccgtcttttacatccgtaaggtcaacctctggaatatagctgtaattgtctgtttcacttgtagcggtgatagacgtgttcccgaacaatttcgtttctgccagtgctttttcagaccaagcgcctgtcatgacaaaatgtgcggttttttcaggtgttaaaaagttcatcggaagcattgagaattgaaggcttgccccgccttgaagaaacaagatatcgtaatcttccggaatgcccatcagttcgattaagaggcttttcgctttttggtgcaccgcttcatactctttgctgcggtgggaaagctccataatagacatgccggattcgttaaaatcaataaattctttctgtgctttttgcagaacttccagtggcagcgctgcaggacctgcgttaaaattcgttgtacgttccattatgatctctccctgttttccacgttaatgtataaaataatacaattatcctatcacaaaaattcagttttttgataaaaaattagaattatcaaaagaaattgacggatgtttgcgaaatgttcacaaaataaaataacctcatcttatgatgaggccaggcgttttgcgatagaggaagagatgttctgcagatcctccggtttataatcatcagcatgcgttttccaaaccgctccgaatccatctccttttccgtagcgagggataatatgcatatggtagtggaacacagattgtccagctttttcgccgttattgttcagcgtatttaagccgatcggttcaaattcatcccggatagcgcgggcgattttcggaacagcatggaaatattgttttgctaattcatctgtaaattcatatacattctcaatatgtgttttcggaatgacaagcgtatggccttttgtcacttggctgatatcaagaaaggcaagtacatgttcatcttcatacaccttcgcggatggaatgtcgccggcgataattttacaaaagatacaattttctgcacaatgcatgagggttcctccttatgaaattgtttagtatgtatacactcatcgtaccacagaaatgcagaaaatagaaaacaggatgaacggcgagcgttcaccctgaatgcagaggaagagcttatatgaagaaaatgtgttatgcctttggtaagcacctcatttgtcaataaaatgaagacttgtttaatgcctaacgattcctgcgataaacacctcatttgacaatttgcttcatacatgaagaattcatcaattcagtgaagagaaatggtttgagcattggacatgtttattttctatccaactgtttctaagacgtctttgacaaacacctcatttttcagttgatatgcttttcctctacaactattatgatgtccagaaccctgtctctttatgacagcaaattcatcatttgttaaaagggaattgtttcaaatcaggccttgtttttggtactatgaagaaaaacactataaggggagaaactatgtctctgctatcggtaaaagacttgaccggcggatatacaaggaatccggttttaaaaaacgtatcattcacccttgaaccgaatcaaattgtcggattaatcgggctgaatggtgctggtaaaagtacaacaatcagacacatcatcgggctgatggacccgcataaaggttcaatcgaattaaacggtaaaacgtttgctgaggatccggaaggctaccgttcacaatttacctatatacctgaaacacctgttttatacgaagaattgacgctgatggagcatcttgaactaacagccatggcatatggactgtcaaaagaaacgatggagaaaaggctgcctccgctactaaaggaattccgaatggaaaagaggctgaagtggttcccggcccatttttctaaaggaatgaagcagaaggttatgattatgtgcgcatttttggcagagcctgcgctctacattattgatgagccttttctagggcttgatccgcttgccattaacgcgctgcttgaacggatgaatgaagcgaaaaaaggcggggcgagcgtgctgatgtcaacacacattttggcaacggcagaacgctattgcgattcgtttattattttacataacggcgaggtgcgggctcgcggcacgctgtcagagctcagagagcagtttggaatgaaggacgcggcgctggacgatttgtatcttgagcttacaaaggaagacgctggccatgaataatatgcttgatatttggcagtcgcggctgcaggagcatatcaaagaaacaagaacatacatgaaatatatgctcaatgatcacctcgtcattgttttgattttttttctagcgggcgctgcaagctggtacagcaaatggatacgggacattcccgctcactttccatccttttgggtgatggccgtgctgttttcgctcgtgttgacaagctcttatgtgcgaacgcttttgaaggaggctgaccttgttttcttattgcctcttgaagcaaaaatggagccttacttgaagcaggcgtttgtctacagctatgtgtctcagctgtttccgcttattgcgctgagcatcgttgcgatgccgctttatttcgcagtcacaccgggggcttcgctcgtatcgtatgccgcggtctttgtccaactgttgctgctgaaagcgtggaatcaggtaatggaatggcgaacgactttccaaaacgaccgcagcatgaaacggatggacgtcatcattcgctttgcggcgaatacactcgttctttattttgttttccaatctgtttatatgtatgcgcttctcgtctatgtcattatggctgtcctttatctgtatatgtcttccgcagcaaaacggaaaacatttaaatgggaaagccatattgagtccgaattgagacgaaagcagcgtttctatcggattgccaacctgtttactgatgtgccgcatttgcgaaagcaagccaaacgcagagcttatctcgactttttgctgcggcttgtgccgtttgaacagcgcaaaacatttgcctatatgttcacccgcgcctttttgcgttcgagtgattatttgggcattcttgtcagattaacgatcgttttcgcgctgatcattatgtatgtctcagctagcccgttgattacagcggttttgactgtgtttgccattttcattacgggcattcagcttctgccgctcttcggccactttgaccatctggcgcttcaagagctgtaccctgtgaaaaaagaaacaaagctgaaaagctatttctctctattaaaaactgcacttagtattcaagcgctgctgatgtctgttgcatctgcctatgcagccggcttgaccggttttctgtacgcgctgatcggttctgccgttctgatttttgttgttttgcctgcttatatgacaaccaggctgaaaaagcacggaaagctgtgaactgaaaagaggtaatcaaatgacagataatcagctgctgatgcaggaagctttggaatggaaaatgcattttttgcgaaaggattccatgtttgaacgcttttcgaagcgtgtgcagacgaaggtgaatgaacggattcctgaaaaaatccatacggtcgtcaccgagagtgtgaaaaaaatggtagaagcgacaatgaccggctccaatatcatcacttataaaaaggatacaagtgcactgtcgctcagtgaaaaaaatgaattggcgaaaaaaacgattgtttcttatcagaaagtgggagctgctgagggagtcggcaccggagcgggcggcatttttttaggcattgctgattttccgctgctgctttcaattaagatgaagtgtttatttaccttgtcttccatttacggctttgatgtgaaagatgcacaagaaagaatgttcttgctgctcgtgtttcagcttgcgttttcgagtgatgatggccgtaaatcgcttttttctgtcatcgaaaattgggagacggagaaaaagagcatcgactggagagtgttccagcaggaatatcgcgattatatcgacgtcgtgaagctttttcagcttttgccgggcgtaggagcggcagtcggcggaattgccaattataagctgcttgctcagcttggagaaacggcaagacatgtttttcatctgaggatattaaaggaaacagccggagaataaacactccggctgtttttttatagctgatgataggtgatcgcagcgccggcaaggaccttggccgctgtcagcatggctttttcgttgatatcaaatttcggatggtggtgggaataaactcggtctggctgttcgggagcggcacctgtaaagaaaaaagtgcctttcacgttttgtaagtaataagcaaaatcctcgccgcccatttgcggttcaccttcaatgacctgctgaacgccctcggtattctttgcggtgctcaccaagtggctcgtttcggcaggatggttcacaaccgccggataaccctgttcataggtgtactcataggacgcgccgtgcatgctgcatattccttttacaaccgctttaatttctttctccagaatgtcccggacattttcatcaaaagaacgtgctgtgccgatgagtactgcttggtctgcgatgacattaaacggattgtctgcgatgaaggaacctgtcgaaatgacggcggattgaatcggattgactttgcggctgacaatgtgctgcaaagaggtaacgatttgagaaccgattaggacggcgtctttagtatcatgcggatgagcgccgtggccgccctttccgaagactttaatcgtaaatcggtctgccgccgccattacggcaccggggcggcaaagaatggttccgagcggctcagttgcccaaagatgagtgccgaatatcacatccgcgttttcgagacagccgtcatcaatcattggctttgcgcctcccggataatattcttctgcatgctggtggatcatcacaaatgttcccttcagttcatgtctgttttggtgaaggaccttggccactgcgagaagagctgcggtgtggccgtcgtggccgcatgcatgcatgacaccaggcactttggaggcgtaagggacatctttttcatcttgaatggggagagcgtcaaagtcggccctcaaagcgactgtagggccgggttcgcttccttctatatatgctaaaacccctctgccgccaacgtttgtgcggattgggactcctaacgattcataataggaagcaataaatgcggcggttttttcttcttgaaatgagagctcaggatacatatgaaaatggcgcctgatctcaaccatttcttcaaaacagccgtcgagctgtttgtttatctctttctgcagtgtggatatggacaaagccgcttcccccttttctatgttttccatgattgtatataaaaagtctgaatatttcaactcatgctgttttaaagcatcatcacagctgcgagggttgtcaccaaaaggccaatcgcgacgggaatgaagttttttctggcaagctcaaaaggatcaactttgcaaatggccgcggcgggaatcagcgcccatgggactagtgttcctccgcccacccagatggcagagatttgtccgagcgcggtcagaacggcgggatcggcatggagagcggacgaaaagagctttgcgatggagccggcgagagaaatgccagaaaatcctgagccgtcaaggcctgttatggctccagcggcagttaatgcagcggcggcaagctcctttgacataggcatcatatgggataaagcaatgccgagatcgttgacaatgccgtgggaacctttagggagtgaagtgcccagtatgctctcatagcctgagtcgccaagataaaagaaagcggcaatcgggatgacggggccgaaaaccttaaaaccgaatttaaatccgtcaataaaatagccggtgattttttcaagccctttatgcttatacacgaaaaaatgaacggtaaggaggatacagattgcagacccgccaattaacgcggtggcatcatttccttgtaggttaaacaagagcatacaggcgatatctgcaagaaaggcaagcggaatcaaaaaagccagtatggaccgcaggcgttttggtaagtacagcgagttgtcttgttcgccggaaagaacgggggaaaaagaagcgggatgctcctgttttttgcgttcgcgctgaatcatgataaaggcagctgttgttgttgtcacacccataatcagcacaagcggaatgctggccgagacgacatcaccgactggaatgcctgctgcatccgcagtcagctttggcgccgcctgaatgacaaagtctcctgacagggcaaaaccgtgtccgaataagttcatggccatggccgcggcaagaggcgtcaaaccggcacgtgcggctgcggggagcaggacggcgccgatcaaagcgacacccggagaaggccagaagaagagagaaatggcgaacatcaggcctccaatcagccaataggcagtcacaggccctctcacaaggcttgcaaagggagaaatcatcgcttcatttatccctgtttttgttaacaaatcactcattgaaacgataaagcaaatgatgaaaatcgtgggcagcagttcgccggccgcatagataaagctgtggaataaactgctgacagaagctgaaagtgaatggctggcccatagcgatatgataaaaatgccgaatagagaaataaatgtcgtgtcttttctcagcagcataaataggataattactccgataaaaaacacatacagaacatggacagacaaaatcccgacttccatcatcgatcactccttccgcttacagattattcataggcgggcggaaggtgccgggacagaggggagggttatgatggaagatgaacattgatctgtttcagctgctcatcagatgatgccttaatactctattcgctttttgcagatgttttgggaagcattcaggagaaaaaatgacgcacccttcagcaaaccagttttttctataggcgatgatgctttccgatggctctaaatatgaatcatcctcgtgctgcatctcgtaatcatcaaatccgaactgaaaaccgcagcacgggcagatttcatgagaatgattgccttcatgatcatatggcggttcagtcaatcccttaaacccgcagactgggcaagtatgcttcattttgctttcctcccaataaaataagctgccggacatgccggcagctattcgacagcgaaatatgtggtgacataggaaggccgggagaagatcgacgttgtgtcaattccggcagatgtatcgcgttttttgtgggcttctttgtaagaaccggactgctgccagtcttgaaaggcgctttccgtttcccacaaggtcagaatgacataggtgtcactgtcaagcggacggagcactcgaattgcttcaaagccaggctcgttttcgacttttcccgctctgtttttaaatctgttttcaaacagcggacgtccttcctgagtgacggcaatattgttcaatactgcaaaaccgggatgtttgatctctccgacttggtcaatgacttcataagcgtgtggtgcctggaaaacggtatctccgtttgtttcatgaatcaaaatggcgttttcctgcccctgcatcaaaaggatattttctgagggatgcttttctacgatcgtttttaaaaaatcggctgtcccatatgtaatataaaccttcatatcagccacctcctgcttgctagtatatcaaaacaatggtataagtttctattggcgagtgcttcgaacataattccaaacaatttttcccatactacctttagaaaggcgaggtgagttcatgtttaagataaagaaaaagaaactttttatacctatcattattttagtgttaactgcttttctcgctttaataggatatatttcaattatttttctcggccattatgtcatagatgaaaagaagctgatacttcatgcttcttcaaaaattgttgatcaaaacggagatgaggttgcaagcctgtatacagaaaatcgtgagccggtctctatcaatgagattccaaagcaggtcagagaagcgtttatcgctgttgaggataaaaggttctatgagcatcacggcattgatgcaaaatctgtcggaagggcagtgtatcgcgatatattagcaggcggaaaggtggaaggcggaagcacgatcacccagcagcttgccaaaaatatttttctgacacatgacaaaacgtttctaagaaaaacaaaagaagtgatcattgcgattaatcttgaacgggattacagcaaggacaagctgcttgaaatgtatttaaatcagctttacttcggacatggggtttacggcatacaagcggcgtcccactattattttaataaagaagtaaaagatttgactgtatctgaaggcgctgttttggccgctattccgaaggcgccttctacgtactctccaattttgcaccctgataaaaataaggagcggcgtgatacaattctaggtatgatgaatgaccaaggctatatcagtgcgaaagaggctgtcaccgcacagggccgaacgcttggactgcacgtgaagaaacagtcggaaaccccttggtttgacagctacattgaccttgtgatcaaagaggcggaagacaagtattccatttccggagagcagcttcttcaaggcggatacacgatcaaggtgccgctcgattcgaagctgcagaagacggcttaccaggtgatgaaagagggaagctattatcccggaacagatcagaatgccgagggaagcgcggtatttattaataacaagacaggcggtgtagaagcggccatcggcggaagggattacacatccaaaggatataaccgtgtcacagctgtccgccagccgggttccacatttaagccgcttgctgtatacggaccggcgatgcaggaaaagaaatttaagccatattctctattgaaggatgagttgcagtcctacggagattatacgccgaaaaactacgacagcatgtatgagggcgaagtcactatgtctgacgccattacgtacagcaaaaacgcgccggctgtctggacgctgaatgagatcggcgtcgaaacaggaaaatcttatttgaaagcaaacggcattgatatccctgatgaaggccttgctctcgctctaggaggcttggaaaaaggcgtttcgccgctccagcttgccggcgcgtttcatacatttgccgcgaatggaacgtatactgaacccttctttatctcgagcataatagatgaagacggagaaacaatagccgattataaagaagaaggaaagcgggttttcaacaagcagacgtcttggaatatgacgagaatgctgcagcaggtagtcaaaaagggaacggccacgtccggcacctatcacggcgacctggcgggaaaaacaggctctacatcttatacaggcgtctccggcgcgacaaaggacgcctggtttgcaggctatacgccgaaaataaccggggcagtctggatgggctatgacaaaacggatcaaaaccattatttgaaagccgggagctcatacccgacgcggctgtttaaggatattttgacacaggcaggagaaaccggtcatgtgttcacaaagcctaaaaacgttaaagacctggaaagcccgattgagctgaagccggtcaaaacactcacagccgattacacatttaaagcagcggggctctttactattgaattaaagtgggacgctcaagaggatgatcgggccgtatacagaatttatgtaaacaaggacggcgaggagacgcttcttgattcggttgaagggaagggaagctatgaaattccttatgccaacttattttcgggcgcgtcttataaaattgtgccttataatacacagacaaaaagagaaggggaaggaaccgattacgttcagccgaaattgttttcctcttaatggaattcggcgattttttgaactttgagctacatttctataccatttgcctaaaacaaggtatagtgtaataagtcaagaaatacgaacgtatggttgccgtatgaaaggtggaaatcagatgagtaaacgagaaacgtttaacgagacgtttttaaaagctgcgcggggagaaaaagcggatcacacgcctgtgtggtatatgagacaagcagggcgctcacagccggaatatcgcaagctgaaggaaaagtacggattgtttgagatcacacatcagcccgaactttgtgcgtatgtcacaagactgccggttgagcaatacggagtcgatgctgcaatcctttataaagatatcatgacgccgctgccgtcaatcggtgtggatgttgaaatcaaaaacgggatcggtcctgtgattgatcagccaatccggtctctggcggacattgaaaaactcggccagattgatccggaacaggacgtgccgtacgtgcttgagacgattaaactgcttgtcaatgagcagctgaacgtcccgctcatcggtttctcaggtgcgccttttacgcttgcaagctatatgatcgaaggcggcccgtcgaaaaactacaataaaacaaaagccttcatgtacagcatgccagatgcatggaatctgctgatgtccaagcttgccgacatgatcatcgtgtacgtgaaagcgcagattaaggcaggcgcaaaagcgattcaaatctttgattcgtgggtcggcgcattgaatcaggcagattacagaacatacatcaaacttgtgatgaaccggatcttttcagagctcgcaaaggagaatgtgccgctgatcatgtttggcgttggcgcaagccatcttgcaggtgattggcatgaccttcctctcgatgttgtcgggcttgactggagactcggcattgatgaagccagatcaaaaggaattactaaaacagtgcagggcaacctggacccgtccattttgcttgcgccatgggaagtcattgagcagaaaacgaaggaaatacttgatcagggtatggagtcagacggcttcattttcaatcttggccatggggtatttcctgatgtcagtcccgaggttttgaaaaaactgacagcatttgtccatgaatattcacaaaacaaaaaaatgggtcaatattcctaagcatatcttttggtatcttaatgatatcctgtcaaaatgtttgtatcagatcattaaagagggtgtaaacagtgagtagaaagaaaatggggcttctcgtgatggcgtacggcacgccttataaggaagaagatattgaacgttattatacacatatcagaagaggcagaaagcctgaacctgaaatgcttcaagatttgaaagacagatacgaagcgattggcggcatttcaccgcttgcccaaatcacagaacagcaggcgcataatctggaacagcacttgaatgaaattcaggatgagattatgtttaaagcgtatatcggactgaagcatatcgagccgtttattgaagacgccgtagcagagatgcataaggatggcattacagaagcagtcagcatcgtgctggcgccgcatttctccacgttcagcgttcagtcctacaacaaacgcgccaaagaagaggctgaaaaactcggcggcttaacgattacgtcagttgaaagctggtacgatgaaccgaagttcgtgaaatattgggttgaccgagtgaaggaaacatatgcgtcaatgcctgaggatgaaagagaaaacgcaatgctcatcgtatccgcacacagcctgccggaaaaaatcaaagaatttggagacccgtacccggaccagcttcatgaatcggcgaaattaattgctgaaggcgcaggcgtttccgaatatgctgtcggctggcaaagtgaagggaacacgcctgatccttggctcggacccgatgttcaggatttaacacgtgatttattcgaacaaaaaggctatcaagcatttgtatatgttcctgttgggtttgtcgcggatcacttagaagtgctttatgataatgattatgaatgcaaagtggttactgacgatatcggcgcaagctattaccggccggaaatgccaaatgccaagcctgaatttattgatgctttggcaacagtcgtattaaaaaaattaggacgttaaagaaggcgatgaacatgagtgacggcaaaaaacatgtagtcatcatcggcggcggcattaccggtttagccgccgccttctatatggaaaaagaaatcaaagaaaagaatctgccgcttgagctgacacttgttgaggcaagtccgagagtcggcgggaaaatccagactgtcaagaaagacggctatatcatcgaaagagggccagactcatttctggaacgaaagaaaagcgccccgcagcttgttaaagacttaggtcttgagcatttgcttgtcaacaatgcgaccggacaatcctatgtgcttgtaaaccgcaccctgcatccaatgccgaagggcgctgtaatggggataccgacaaaaattgcgccgtttgtttctacgggtctgttttctttgtctgggaaggccagagctgcaatggatttcatcctgcctgcgagcaaaacaaaggatgatcagtcattgggagaattcttccgcagacgtgtcggagatgaagtggtcgagaacttaatcgagccgcttctatcagggatctacgcaggcgacattgacaagctcagcctgatgtcgacatttccgcaattttaccagacggaacaaaagcatagaagcctgattctcggcatgaaaaaaacaaggcctcaaggctcaggccagcagctgacggcaaaaaaacaagggcagttccagactctgtcaaccggtttgcagacccttgtagaagagatcgaaaagcagttaaagctgacgaaggtgtataaaggcacaaaagtgaccaaactcagccatagcggctctggctattcgctcgaactggataacggcgtcacacttgatgctgattcagtaattgtgactgctccgcataaagcggctgcgggaatgctttctgagcttcctgccatttctcatttgaaaaatatgcactccacatccgtggcaaacgtcgctttaggtttccctgaaggctccgtccaaatggagcatgagggcacgggttttgtcatttcaagaaacagtgactttgcgatcacagcctgtacgtggacgaataaaaaatggccgcacgcagcgccggaaggcaaaacgctgcttcgggcatatgtcggaaaagctggagacgaatccattgtcgatctatcagataatgacattatcaacattgtgttagaagacttaaagaaagtcatgaacataaacggcgagccggaaatgacatgtgtcacccgatggcatgaaagcatgccgcagtaccatgtcggccataagcagcgtatcaaggagctgcgtgaagcacttgcatctgcgtatccgggtgtttatatgacaggcgcttctttcgaaggtgtcggcattcccgactgcattgatcaaggaaaagctgccgtgtctgacgcgcttacctatttattcagctaaaacctccgctttatcgcggaggtttttttgatgtgcaatggcaatattgtgtaaaaaaatgattgaattgaacggcaggttatgatacatttgcatatgtacttaatgactaaaatgttcaaacggtcagtttcgaggtgaatacaatgtcaatagatcgaaaaaagctcattttggaggcggctacaaagtctttcacgcagttcgggtataaagcgacgacaatggatcttgtcgcaaaacttgcgaacgtggggaagggaaccatttatacttttttcaaaaacaaagaagagctgtttgacgagattttcactactttattaaaggaaatgaaacaaaaagcggatgaagcgatggagccgaaccttccgttccatgaaaatgtgcacagagcgctgtttgccattctggagttcaggaaaacacatcagctgacgattaaaattttccaagagaatgccgagattggtacaatggctgttcaggaagtgatccagaaaatggagcgagccatactgtcttatatcaaaagtaagattgaagacgggatcaaaagcggcgcaatcaagccgtgcgaccctgaactgacagcctttgtgatgctgaagctttatatcgcgctcatttttgactgggaaaaacaacaccccccgcttgataaagagacaattgcgggactgcttgaattgtatgttgtcaaaggattgtcagcgaactagataatcctttctctttgcaagaaaatgaccatttttcatgatgagtcagttttagaatggaggcatcaggatgaacacaatacgaagtcagtggaaagacatcgtaacaagtaaaaaattattgattcccatcatcgccattttgtttgtcccgcttatttacagcggcgtattcttaaaggcttattgggacccgtacggcacagttgaccagctgcctgtcgttgtcgtcaaccaagacaagggagcaacgtatgaaggagaaaaacttcaaatcggtgatgatctggtcaaagaattaaaggataataacaactttgattggcatttttccaatgatctcgaccaatcgttaaaggacttattgaatcaaaaatattatttagttgtcgagattcctgaggatttttctaagaatgccagcactgtattagacaaaaatccgaaaaaattggatctgaaataccatacaaatgcaggttctaactatgtaggggcaacgatcggcgaaaaagcgattgataaactgaaagcctctgtttcaaaagaagtgaccgagcaatatacgaaagttatttttgataactttaaagatatcgcaaaaggtttgagcgacgcgagcagcggcgcgaaaaaaattgatgacggcacaaaggatgcgaaaaacggaagcgcccagctgaaagaaaatctggcgaagctgaaggaaagcaccgctaccatcagtgacaaaacagcgcagcttgcagatggagcggctcaggtgacgagcggcatccaatcgcttgacagctcgctcggtaaattccaggacagcagcaaccagatttatgataaatctggccagcttgcagcaggatcaggcaagataacgggcaagctgaatgaactgaatgccggccttcaaaaggtgcagcagggcttgcctaatctgacaaacgggctggatcagctaaacagtaaagcgcaagaaggttctgagaaagcatcaaaagcggaaaaacttataaatgcgctcgatttaacgaagcttgaaacagctgtgaataacctcgaaaagtcagaaacagcgatgaatgaatttaaaaaacagctgtctgactttgaaaacagcttaaaaaaccgtgatcaggcatttaaaaatatcatcaactccagtgatttcttaacagcggagcaaaagagccagctgatcagctctgttgaaaagcagcttccgaaagttgatgcgcctgattttgatgaaattttaagtgggcttccttcagctgatcagctgcctgacatcgcaacgataaaaagctcattggaagatgtgaaagcgcaggttgcccaggtgaaggcattgccggaagctacctctaaactttataacggcgcaaaagccactcaagacgcgattgacaaattaactgctggatctgagaaattatacaatgcgtcacagcaggtgacagatggccaaactaaactgacagccggcatcggtgaatataataagcagttcgcaaaggcaaaagcgggctcagagcaattggtgacaggaagcagccaagtatccggcggattgtttaagctgttagacgggtctaaacaggtccaaagcggatcatcaaaacttgcagacggatctgcatcacttgatacaggtttaggcaagctgttggacggcacaggagagctgtctagtaagctgaaggatgcggctgaccaaacaggagatatcgatgctgatgatcaaacatacggcatgtttgcggatccggttaaaaccaaagatgatgccattcattccgttcctaactatggaacagggctgacaccttatatcctgtcaatgggcttatatgtcggcggcatcatgctgacggttgtcttcccgctgaaggaagcgtcagggcgtccgagaaatggttttgagtggttcttcagcaaattcaatgtcatgatgcttgtaggaatcattcaatcattgattgtggcgacggttcttctattgggaattggtctcgaggtagagagcacgtggagattttacgtgtttacgatcattacgagtctagcttttctagcgataattcaatttttggctacaacgatgggcaacccgggacgatttatcgcagtcattattttagtgctgcagctgggagcgagcggaggaaccttcccgttggaattgcttccgcatttctatcaggtcatccatggcgcattgccgatgacctacagcattaacggattcagagcagtcatttcaaacggtgactttggctacatgtggcagatggccggcgtcttaatcggcatcgccctcgtcatgattgcactaagcattacttactttacaatgttaagccggaaggaagaaacatcagaagaacagccggcttcataaagaaaaagaacttgtttccttggaaacaagttctttttttgttacattccccatttaataagcaatcctgtataggttaatccgccgccaaacccgaaaagcaaaacgatttgatcttttttcagcttcccggctttcactgcgagatcaagcgccaaaacaattgaaaccgaagatgtgtttccgtagtgctcaacactagtgagcgttttttcaatcgggaacggtgttttttcacaaattgactcgatcatgcgcaagttcgcgctgtgaggaacaaaccaatcgagatcatcagagctgagtcctgctttatgtaaaagccgttcaaattcgccagggacagttcttgcggcccatttatatacctcgcgtccgttttgcaccatttttccagaaccgacaagctgcacaccgtttatttcatttcgcagtccggcacgatacaaaatatcgccgccgttcccgcttgttccttgtacagacgcaagaaatcccggcgtttcttcatctcgttctactaacagcgcacccgcggcatcgccgaacagtacgcatgtcgttcgatcggtataatcggttacctttgataacgtctctccggcgatgacgagaattttttgatgaaggccagatgtgatcaatccatttgccaaatggaggccgtatgtcagcccggcgcatgtcgcattaatatccagcgcgccggtgctttcccagccgaaatattcctgtacgcggcatgccgtactcggaaaggcgtaatcggatgtggttgtggcaacgaggatcatatcgacatcatcaagcgttcctttataacggctcttgagattcttcaccgcttctatgcataaatcagaggtaaattgatgttcatccgcaatccggcgttctctcattcctgtgcgctgaacgatccattcatcagaggtatcaacgatcttttctaaatctgcattggttaaacgtctgctcggcgcataggtgccgatagctgtaatttttgcttttgacatatgaatcactccttatggtcagattataacactagatattagtatctggtactaaaaagaaggtttttttacaaaaaaagagaagtgtagataggaatctatgaaaaagaaaaaggaggctgaaaaatggtcagtcaagaagcagtagtctttttggcattatccggggctattgcgtttctgttgccaatcgggctgattgtatggtttaagcgaaagtatggtgcctcgcttaaagtgttttttattggcgctctcacgttttttgtcttcgctcagctgctggaaggcggcgttcatgtttatgtactgcaagtgaatgaaatgacgaaagaagcgatgcagcatccattatggtatggcatttacggctgcttgatggccggaatttttgaggagtgcggaaggtatatgatgatgcgattttttatgaagcgccatcatacttgggcggatggtctggctttcggggcaggccatggcgggcttgaagccatcctgattacaggcttgtcctctatctcacttattgtatacgcatttgcaatcaatagcgggacgtttgaacagcttttggtcaatggcgacgtcaaacaggcgcttttgccgatacaggagcagctgctgcatactccttcgtatgaatggatgctgggcggaatagaaagaatcagtgccattgccgtccaaattgggctgtctctgcttgttttgtacgcggttaaaagccgccggccgctgtttttgttgtattctattcttttacatgcactgtttaatgtaccggcggttttatatcagagaggaatcatagagcatgctgctgctgttgaaatcattgttgctcttatagcggctttatcagtttattggattgtaaaagcaaaaagggtgtttcaataaaaggtccaagcagcagcaatgcccgcttggaaaaatgtgaatggaaatattcattaagcgtgggtcatcagaatatttctgattcagtctttagcaatgacagcaagaatgtctgtgttttttacaagagaaacaatggtgtttctttttcttcttctcgcaagggtcatggcattctttctttttcttgcaatggtcgtggaaatctttatcgaaccactcgtcaaagaaccaaaaatcatcgaaccaatcgtgacaacgacatttctgttcatgtgaatgacgacagcacatagaaatccctcctcttcccatgctctctacagcatatgagagattgataggaaaagattggacgggtccctcgggaaaagagtatattttaagtagaaaataaaaggaggaatgccctatgacgtccgtacgtaaaacgatggagctcattaaagaacttgtatcgatcccaagcccgaccggaaatacatatgaggtgatcaattatattgaaagccttttaaaagaatggaaggtagaaacggttcggaaccacaagggcggcttaattgcaacgcttccaggacgcgacacatcccggcatcgcatgctgactgcgcacgttgacaccctcggcgctatggtgaaggaaattaaagcggacggccggctgaaaatcgatttaatcggcgggttccgctacaactcgattgagggagagtattgccaaattgaaaccgcctcaggaaaaacgtacacaggcacaatcttaatgcatcaaacgtctgtgcacgtatacaaagacgcgggaaaggctgagcggaatcaagagaatatggagatccgcctagatgaacctgttcactgccggaaagatacggaggagcttggcattggcgtcggagactttgtgtcgtttgatccacgtgtcgagatcacatcaagcggatttattaaatcgcgccatttggatgacaaagcaagcgtcgccttattgctccgcttaattcatgaaattcaaacagaagacattgagctgccgtatacaacccattttcttatttccaataatgaagaaatcggttacggcgggaattcgaatattcctcctgaaacagttgaatatttggcggttgatatgggcgctatcggtgacgggcaggcgacagatgaatattcagtatcaatctgtgtgaaggatgcgagcgggccgtatcattatcagctcagaaagcatttagttcaattagccgagaagcatcatattgactataagcttgatatatatccgtactacgggtctgatgcgtcagcagcgatcaaatccgggcatgatattgtgcatggcctcatagggccgggaattgacgcttcccatgcatttgaacgcacccataaatcatctcttcgccataccgctaagcttctgtattactatgtacagtcaccaatggtataagggggaggaccaatgaagatttataagctgaaaagcacattcggttgggaaggtgatgacgggttgggagaacagctgattcagcagatccttgccggagaaaaaaacgccacgtgcgcgccgaaatcattgtattcaaaagatgaattgagggacgtttatcaaacagcgggtcagcttgttaccgtttatgataaacatgacaatccaagatgcaatataaaagtaacagatgtctttgaaaccacctttggtgcgcctgatatgaggttagtcaaaggagagggcaatggagaccgaattgaggagtttcaagaggatcatcggatggcatgggcggaactgatcaaaagcggtgaactggagctgaatgaggatactgttttgattacagagttgtttgtgcttgttaaagattaaaaaagcctgcggggcaagaaccccgcaggcttttcattaaccagaaatggttgcgttttgttctgttttcgattgggacataacagtttctgctttcgcaggattaaacatgccttcccatttagacatcacaacggcagcaagcgcgttaccagtcaggttgacaactgtacgtgccatatccatgatgcggtctacgccggcaataaaggcaagtccttcagccggaacgccgatggtgccaagcgttgcaagcaagacaacaaaagaagtaccaggcacggcagccatccctttagatgtcaccattaagacgagcacaagcgtaatttggtgccaaatcgtcaaatcaatgccatatacctgtgctaaaaagagtgcggcaatagattgatagagaacggaaccgtctaagttaaacgtgtaaccgatcggaatgacaaatgaaacaatgccttttggacatccgattttctccattttttccatgatacgaggaagaaccgtttcagagctggacgtactgaacgccagtaagatttcgtccttcatgtaagcaaggaacttgaagatgctgatgccggcaatttttgcgacaatcccgaaaataacaattaagaagaaagcaagcgcgacataaaccaatccgacaagctttccgagagagataagagaaccgagtccgaatttagacacagtcactccgataagagcgaaaacgccgaatggcgccactttcatcacaaggtttacaacgtggaacatggcatgggatacaccttcaaaaaaggctaatacaggcttgcctctttcaccgatcgcggaaatacccaatgcaaatagtactgtaaagcagatgatggctagaagatccccttcgaccaatgactggaagaagtttgtcggcacaatatggaggaacgtttccgccactgatttattactttgttctttttcagtttcaacatattgactgatgtccgatttttgagcttcgtgtatattaactcctgtacccggatggaagatgtttgcaagggctagtccgagaataatggcaaaagtcgtgatgatctcgaagtacagaatcgttctgaagcctaatttaccgacttgctttccatttcctgcaccggctacaccgatgattaagctggagacaacaataggaatcactatcattttgattaagcgtaaaaagagatccccgattggctgcaggtaagtaggcaatgctgggttgccataccaaatgacgccaacaatgacacctagaataagtccaacgaatatttgtgtggctaatccaaacttaattcttttcatagattacctcccaaaaaacaaagtatcaacatatatcatgaatagacatatatttaatctcactattagatcaaattataatagataagaaatcaattcgtctatagtaaattatatttcgaaaataaagaatattcaatgacattatgataatcaccagaattatctaaaaacaggtgagctttgacctaacctgactattatttcaaaattaagagatatgtgaaaaaataagaaaatcccacgcgtaaggcgcgggattttcgctcattacaaatcgtttacttttatacagtcattgcagatattaccataacactcatgctgctcttctatcttttttccgcattccgcacactttttcgaaggcaggtttctaaaaaattctgtgattttccccagcataaccaatccctctttcccctttgtagtgatttcattgtaatataacagatcgcaaaaatcaataactgttttgatacaatgtttaaaacatgcttttttcaagaaaaatgggtatattgaaggaggatcaattttttttgaaaagataggaggacattatgaaagttacagttatcggatgctatggcggttttccggccgcaaatgaagcgacgtcaggctatttgtttcagtcaggtgattactctctgcttgttgattgcggcagtgccgttttgtctaagctgttcggatatgtgccggcggaaaagctggatgcggtcgttctgtctcattatcaccatgaccatatcgctgatatcgggccgctgcaatttgccaagcaagtcggttcgtttctcggcaaaggagagcatacgcttccgatttacggacatgatgctgatatagaacagtttcaaaagcttacatataaaacacatacaaaagggatcgcctatcagccggatcagccgttgactgccggtccgtttacgatcacctttttaaaaacgattcacccggtgacgtgctatgccatgcggattactgacggcagccacactgtcgtttatactgctgattccagctatcaggattcatttataccgttttcgaaagatgctgatttattgatctcagaatgcaatttttatgccgatcaagacggaacaagtgcaggccatatgaacagcctggaagccggacgcattgcaaaagaagccggagcgggagaactgctgctgacacatttgccgcattttggcgtgcatgacaatcttcgcaaagaagcgaaaaccgtttttaacggagaagtgaatattgcgaaatcaggttttgtgtgggaaggataaaggaggagcaccatgttatttatagacaatcaaaatatcaatgatccgcggatcaatcttgctatcgaggagtactgcgtaaagcatttagaccctgaacagcaatatttgctcttttatgtgaatcaaccgtctattatcattgggaaaaaccaaaatacaatagaagaaatcaatacaaaatatgtagaggaaaacgggattatcgtcgtccgccgtttatcaggcgggggcgctgtgtaccatgatctggggaacttgaacttcagctttattaccaaggatgacggggacagctttcataactttaaaaaattcactgagccggtgattcaggcgttacatcagcttggggttgaagctgaattaagcggccggaacgacattgtagtggatggccggaaaatatccggaaacgctcagtttgcaacgaaaggccgtattttcagccacggcaccctcatgtttgattcagccattgatcatgttgtatcagcattaaaggtgaaaaaggataaaattgaatcaaaaggcatcaaatcgatcagaagccgagtagcaaacatcagtgagtttctcgatgataaaatgaccaccgaagaattccgcagccatttgcttcgccatatttttaacacaaacgacattggaaacgtgccggagtataagctgacggaaaaagattgggagaccattcatcaaatttcgaaagagcgctatcagaattgggattggaactacggccgctcgccgaaatttaaccttaatcattcgaaacgttatccggttggatcgatcgatttgcgcctagaggtcaagacaggcaaaatcgaggactgcaaaatcttcggagatttcttcggtgtcggtgatgtatctgaaattgaaaacctgctggtcggaaaacaatacgaacgcagcgtcatcgctgatgtgctcgaaggtgtgaatctcaagcattactttgggaacattacgaaagaggatttccttgatctgatttattaaggcaaaacacatcgtttgaaagagcggttgtgtttttgaaataatggaggcaggagggattcacatgaaagtgtttttaatcggagcgaacggacaaatcgggcaaagactcgtctctttattccaagataatcctgatcattccatcagagcgatggtcagaaaagaagaacagaaagcgtctcttgaagctgccggtgcagaagctgtgcttgcgaatctggagggcagcccggaagaaatcgccgctgcggcaaaaggctgtgacgcgatcattttcacagccggttccggtggcagcacaggctatgataaaacactgctggtggatctcgatggagcggcgaaagccattgaagctgcggacattgccggaatcaaacggtttattatggtcagcgccctgcaagcccataaccgtgaaaattggaatgaggcactcaagccttattatgtggccaagcattatgctgataaaattctggaagcgagcggtttaacctatacgattatccgtccgggaggccttcgcaatgagcctggaacgggaactgtttcagcagcgaaggatctggagcggggatttatttcccgtgatgacgttgcaaaaacggtcattgcctctttagatgagaagaatacggaaaatcgggcctttgatctgacagaaggagatatgccgattgccgaagcattgaagaaactatgacagtactgacactcagggctttttgctcttgagtgtttttttctgtttctctataatggaggagaaagcttggcttcaataatgaatgactattcattcactttaaggggtgggagaatgaatcttgtttcaaaattggaagaaacagcatctgagaagcccgacagcatcgcatgcaggtttaaagatcacatgatgacgtatcaagagctgaatgaatatattcagcgatttgcggacggccttcaggaagccggtatggagaaaggggaccatctagctttgctgcttggcaattcgcctgattttatcatcgcgttttttggcgctttaaaagctgggatcgtggttgttcccatcaatccgttgtacacgccgacagaaattggttatatgctgacaaatggtgatgtaaaggcaatcgtgggcgttagccagcttttgccgctttatgagagcatgcatgaatcgctgccaaaggttgagctcgtcattttatgccagacgggggaggccgagccggaagcggcggatccagaggtcaggatgaaaatgacaacgtttgcaaaaatattgcggccgacatctgtcgctaaacaaaatcaagaacttgtccctgatgataccgcggttattttatatacgtcaggaacgactggaaaaccgaaaggcgcgatgctgactcatcagaatttgtacagcaatgccaacgatgttgcaggctatttgggaatggatgagagggacaatgtggtctgcgctcttcccatgtttcacgtgttttgtttaaccgtctgcatgaatgcaccgctgatgagcggcgcaactgtcttgattgagcctcaattcagtccggcatctgtttttaagcttgttaagcagcagcaggcgaccatttttgccggtgtgcctacaatgtataactacttgtttcagcatgaaaacggaaagaaagatgatttttcttccatccggctgtgcatttcgggaggcgcggccatgccagtcgcgttgctgacggcgtttgaagaaaaattcggtgttaccattttggaaggctacgggctctcggaagcatcacccgtcacgtgctttaacccatttgacaggggcagaaaaccgggctccatcgggacaagtatcttacatgtcgaaaacaaggtcgtagatccgctcggacgcgagctgcccgctcaccaggtcggcgaattgatcgtgaaaggccccaatgtgatgaagggctattataaaatgccgatggaaacagagcatgcattaaaagacgggtggctttatacgggggacttggcaagacgggatgaggacggctatttttacattgttgaccggaaaaaagacatgatcattgtaggaggatacaatgtgtatccgcgggaggtagaggaggtgctgtacagccatccggacgtcaaggaggcggttgtcatcggcgtgccggacccccaaagcggggaagcggtaaagggatatgtggtgccgaaacgctctggggtaacagaggaggacatcatgcagcactgtgaaaagcatctggcaaaatacaagcggcctgccgccattacgtttcttgacgatattccgaaaaatgcgacggggaaaatgctcagacgggcactgagagatattttgccccaataaaatgaaaaagcgaagcggttagcttcgctttttcattttcaatcctttgcttcttttttaataatatttagcagcgcctttgtatcatttttgcttaatttgtagtatgtgccatccttcaaaaaaacggcttgctggctgccgtcaatccatagtctgaatgagtcataccggtctttatgaaacttgattgtcccttcgtaatcaggggctgatgttttttctgtcttcacctgttttccctgattcataatatccagcatatctttgacgtgctgtcttttttcaatctcgatatcttcctggccgcttgaagacagtgtgatcaaatccgcgtctaccgattgatacacatcgcctgatcggctgtaaagataaaaaaatgcgataaacacaagaccgattaccacgatggctgccactatttttttcatttgcatcactccaaacattgttagttttcccagcgatcgggctttccatgcttaaaagggtggaaaagtgcggaacacagcttggttctaagaatttgaatttatgattacaatagaagtaacgggttgatgtgaggagtgaggcgttatgcgcaagtggattgcggcagcaggacttgcttacgtgctgtacgggctgtttttttattggtattttttcctgtcgggtgattccgcaataccggaagccgtgaaagggacgcaggctgatccggcttctttcatgaagccgtctgagttggcagtggccgagcagtattcgaatgtcaagaattttttattttttatcggggtaccacttgattggtttctgttttttgttctgcttgtcagcggtgtttcaaagaaaatcaagaaatggatcgaagcggccgtgccttttcggtttttgcagaccgttggttttgtgtttgtgctttcgctgattacaacattggtgacgctgcctttagattggataggctatcaagtatcgcttgactataacatttccacacagacaacggccagctgggctaaggatcaggttatcagcttttggatcagctttccaatctttacgctttgcgttctcgttttttattggctgatcaaaaggcatgaaaaaaaatggtggttatacgcctggctgttaacagtgccgttttcgctgtttctgttttttattcagccggtcattatcgatcctttatacaatgatttttatccgctgaaaaacaaagagcttgaaagcaaaattttagagctggcagatgaagccaatattccggctgaccatgtatatgaagtgaacatgtcagaaaaaacaaatgcgctgaatgcctatgttacaggaattggggccaataaacggattgtattgtgggatacgacgctgaacaaacttgacgattcagaaatcctgtttattatgggccatgaaatgggccattatgtcatgaagcacgtttacatcggtctggctggttatttgctcgtgtcgctcgccggattttatgtcattgataagctttacaagcggacggttcgcctaacccgcagcatgtttcatttagaaggacggcatgatcttgcggcacttccgctgttattgcttttgttttctgttttgagctttgcggtgacgcctttttctaatgctgtctcgcgttatcaggagaataaggctgaccagtatgggatcgagttgacagagaacagagaagccgctgttaaaacgtttcaggatttggccgtgacggggctgagccaggttgatcctccggtgcttgtgaagattttcagaggcagccatccttcgatcatggaacggattcaacatgcggagaaagaagagaatgcgccggaacatcaggatgctgacaaataaaaagaagcaggtatggaggaacctgcttctttttactattattgtgcagctgcttgtacgttgattaacccttttccatagtagaaagagtttccaagatatgttgcagtgctttctaaacgatcacggacttgcgcgtttgtccaagtcgggtgcttagaaagaattagcgctgctgctccggcaacgtgaggagtcgccatggacgtgccgttgtaagcaccgtaagtgcctccaggaagtgtgctttggatggatacgccaggagccatcacatcaagctcagaacctgcgcttgagaatgaagctctttggttgctgctgtttaccgcacctaccgcaatagtagaaggatattttgcagggtagccgactgtgcttgagcttccggacgaaccttcgtttccggcagcggcagcaacgacgataccgctggaaacggctttatcaacgactgttttcagcgctgtagaaccagaaggtccgccaaggctcatgttaataacatccatattgttggaaatggcccattcaatgccgttaataatccagctatattggccgcttcctgttgaatcaagcacttttactgcatataatgatgcgcttggcgctacgcccagaacaccgattgagttattaagagcggcaatcgtaccggctacatgcgtaccgtgagaactgccgtcctggtatgggtttgtttcagaaggtacgaagcttgctccgcctctgacgtttaagtcaggatgagaagagtcaattccgctgtcgataacagctacttttacgttagagcctgtgtagccttgagagtgaagagccggcgctttaatttgagaaatgccataaggaacagattgcgcatattcatgtgcaatatgatcttcttccacatatgcaacgctcggatcttttttcaattcttttacagctttttcatccaatgttgctgcggccgcgttaacatacttaaattgcttttgaacctttccgcctttttcagaaataacatcctttttcttggcggaactcatggcactcattgtctgtttaaatccgacaatgtatttcttttctgtactgctttttccggcagcctgcgcagacatgttgctgaacgccatcgtaaagattaacgttaacgcaaacaacaagctgatccacaattttttgcttctcactctttaccctctccttttaaaaaaaattcagagtagacttacttaaaagactattctgtgaatttattgtaatagatggaataatattttagtagacccatttttttgagatgattttatctctatttaggtatatcatctctcgctatttccgtagagactcgaaataactattttcatacagaaaagaacgaaaatagacatgagtaaatgttcattatgctgaaatgtcatgcttttttaggttaaatgctcctgagtcccggcaaatttctgtcgaaaaaattcgttcaaatgacctgcgtgtgcttccgtgagaacaatggatattatcgtgatattttttcaaagcatgatgataaaagtattctgaaaaataaactttacagaaaagggatagaatgaaaaaattattgagagggaggaagaaataagatgaacattcgccaagcaaagacatcagatacggccgccattgcgccgttgtttaaccaatatcgggaattttatagacaggcatccgatttgcaaggggcagaggcttttttgaaagctcgtttggaaaatcacgagtctgttattttgatagcagaagaaaatggagaattcataggctttacccagctctatccaacgttttcttctgtgtcaatgaaaaggatatacatattaaatgacttatttgtcgttcctcatgcacgtacaaagggagccggctgccggctgctttctgccgcaaaggattatgcagaggaaaacggggcaaaatgtttaacacttcagactgagcaccacaaccggaaggcaagaagcttgtatgagcaaaacggctatgaagaggataccggatttgtccattattgtctcaatgtgccggcgaagtgaaaatggcggcttgatgatttggttttttgaacgttcttcggttacgatataaatgaaaaggagtgtgccgaatgtcaacgttatttcaagccttgcaggcagaaaaaaatgccgatgatgtttcagtccatgtgaaaaccatatcaacagaggatttgccgaaggatggtgtcctgattaaagttgcttattccggcattaattacaaagatggtctggccggaaaagcaggaggcaatatcgtcagagagtatccgcttattttaggcattgatgctgcgggtacggtcgtctcttccaatgatccgcgttttgcggagggggatgaggtgatcgcgacaagctatgagctcggtgtctcccgtgatggcggattaagtgaatacgcttcggtgcctggtgactggctggtgcctttgccacagaatctttcgttaaaagaagcgatggtgtacggaacggcgggatttactgcggcgttatcagtgcatcggcttgaacagaacggtctgtctccggaaaaaggcagcgtgctagtcacaggagcaaccggcggtgtcggcggaattgcggtatcgatgctgaacaagcggggttatgatgtggtggcaagtaccggaaaccgggaggcggctgattatttgaaacagcttggtgcaagcgaagtaatcagcagggaagatgtctatgacggaacgcttaaggcgctgtccaagcagcaatggcagggagcggttgatccagtcggcggaaaacagcttgcctcgcttttaagcaaaattcaatacggcggatctgtcgcagtgagcggcttaaccggcggaggagaagttccggcaaccgtgtatccttttattcttcgcggagtaagcctgctcggaatcgattcagtatattgtccgatggacgtcagagccgctgtttgggagcgcatgtcttctgatctcaagcctgatcagctgctgaccatcgtggacagggaagtatcattggaagaaacgccgggtgcgttaaaagatattttgcaaaatcgcattcaaggaagagtgattgtgaagctttaacaggatcagcttgcagagaatgttatttttctgcaagcttttttgtggacaggatgatcagctgctgaactgctgtgtcgcgaaacaagattttcctgtaagccgaactttctcttctcattttaaaaataattggtgataatgattctcattccgtgttatactactcttggacatcttaaccatagaaactaccaacaggagagactggaacatatgaaaaaaacactgattattcttacagttttacttctttctgtcttaacggctgcttgctcgtcttcaagcggcaatcaaaacagtaaagaacataaagtggcggtaacacatgatttagggaagacaaatgtgcctgagcatccgaagcgggttgttgttcttgagctaggttttattgatacactgcttgatctcggcattacgcctgtcggggttgccgatgacaacaaagcgaagcagctgatcaacaaggatgtgctgaagaaaattgacggctacacatctgtcggcactcgctcacagccaagcatggaaaaaatcgcttcattaaaacccgatttaattattgctgacacgacccggcataagaaggtgtacgatcagctgaaaaaaatagcgccgacgattgcacttaataatttaaatgctgattatcaggatacaattgacgcttcgcttacgattgcaaaagcagtcggcaaggagaaggaaatggagaaaaagctgacggcgcatgaagaaaagcttagcgagacaaagcagaaaatcagcgcgaacagccagtccgtgcttttgatcggaaatacaaatgataccattatggccagggatgaaaacttctttacatcgagacttttaacacaggtcggctaccgatatgcaatcagtacgtcaggcaatagcgattcaagcaatggcggcgactctgtgaatatgaaaatgacactggagcagctgctgaaaacagatccggatgtgatcatcctgatgacaggaaaaacagatgacctcgacgccgacggtaaacgcccgatcgaaaagaatgtcctttggaaaaaactgaaggcagtgaaaaacgggcatgtataccacgtggatcgtgcggtgtggtctctgcgccgcagtgtagacggggcgaatgccattttggacgagcttcaaaaagagatgccggctgctaagaaataaaagaaaagacaggcaaacgcctgtctttttcttatttgataaagccggataagtggctgttgatattatagtcttttatccgccatttttcttctgcaaattcaatgttgctgaggcaggcgttgacgagacgggtgctttgaagctccgggtcaccgccggatatttctgtcagcagggcgtgaattgccgcaccgtgcgccacgatcagcaccttcttgtttggatacgcctgattcacttttgccaaaccgcccatcagcctgtcagtgagttcttctaaggtttccatattcggatagatgttatctggatagcgctttgtccgttcctccagcggcatgccctccgcgtcgccgtaatcgcgttccttaaaatcatccatctcgactatcggaagatgcagatattcattaataatttccgcggttcttttcgctcttttcagcgggctcgtcacaataatatcccaagaaaagtcctttacatattctccggtttctcttgcttggcgttcacctgttgcgtttagcgggatatcggttttgccttggcatttttgctgcaggttccaatcggtttctccatgtcttactaaacaaacggctgtcataaaatccccttcctgactttattcatatcgctattatactaaatcgaaagcgtgtgtcctatgaaaaagcctatgcaagaacttcaaataataaagcaagtccaattccgccgccgcttccgatggctgcaaccacatattgacagtctgtccgtcttttcgcttcataaaacaatctggttaccagagctgcacctgatgcaccgtacggatggccaagagctaaggcgccgccgcgcacattgatttttgaaaagggaatgccgagttcttgcgagcagacacaaattttgacggcaaaggcttcattgatttcaaataaaccgatatcctcaggtgttacatcgtgtgtatgtaagaggttacggatcgcatcaaccggtgccgcgggcggatagttggggtgaatcccactgactgcgctgccgataaaccggagcacaggcttaagtcccagggctgccgctttttcttcttccattaccaaaagagccgctgctccgtctgctatgccgctgctgttggctgctgtgactgttccggagctggtgtcgaaaaccggctttgcacggggaataatcgcttctattggccgcgttttcaaaaatgcttcgtccgtctccaattccccgagaggaacaatttcttcacggtaaaatcctccatcatgcgcgttcctgctgcgttgatggctgagaagggcgtactcatcctgcatgcttctgctgatggaatagcgtgcagccgtatattctgccgcaatgcccatgtctggatcgccgatggcatctggagaaaagcgggcccgttctgaaaaaggggattggctgctgctttctgagccgcccgcgatatacatcgtgccggctcccgcttgaataaggctgcaggcatagcgcacagcttcaaggccggagccgcactgtctgtcaattgtcattccgggaactgataaaggcagtccggcttgaagggctgacagtctggcgaggttgccgcctctgccggtagcgtttccgagaatgacctcgtcaacttgatcctctagctttcggctgagacagcggatgatgggagctgacaaatcctccggcaggaagggcttcagcagtccgttttgatttccaaagatcgttcgttttgcatcaacaataaccgcattcatttatactgtatactctcttccagccattttttcactctggaacgggcaatttttccgctgctcgtttccggcaagctgtctgcaaacacccattttttcggaattttataggaggctaatttctgtttacacaaggctttcagtgttctggcattagcgtttccatgaatgacagctacagcgatttctccccaatactcgtcgggaatgccaacgacagccgcgctttcaacctctgggcaggcgagaagcacacgttcaatttcttctgggaaaatatttaatcctccgtacacgatcatcccgttttctcttcctgatatgtatagaaagccctcttcatcaacatagcccatatcatccactgtcatccattcatctggtgtgctgccgttcacatagccggaaaaccgcatcgggctgttgacaaatatttttccgacttcgcctggctgacagcgttctccttcagcgttgcggatttcgatccggacattatgaaaagggcggcccgctgaatgcggtttccgtttgctgtcttccggtgaagaaaacgtcacaaaactaagctctgatgtgccgtaaaaatcgtacagcttgagatgaggccatgcagcggcaagcttctccttggattctgccggccagtctgcgccggatgaaatgattttgacgggactgtcgggaaaaccctcaatccttgtgagggcgtctgtcatcgtcggtacggtatagagaacactgatggattcacggcacagccattccttcgctttggcaggagaaaactttttcagcaaacaaacggttcctccgagaaacaaagtgctgactgccccgtataagaagtgagaggacattaacgtcccgggaatcaataccgtgtcatttgatgtaattgaaaaatctgtttctgtacaggtaaagctctctatccatgagcggtgagatcgcgtgaaggccttcggttttcctgtcgagcccgacgtaaatcccatataaaaagggtgctccggatcaatggtaggcaagggatcagcggttgcttcagaaatatctgccatacagttatccagcaaaacaacaggtgtctggctatctgtcagtttgtttttgaaaaaggctaaagtaaccacaagatccgcattgcttatggacagccgctccttacattcagccgggctccagcgtgtgtcgatgggaatggctgtgcaaccagccgctgcggctccggcaaacagctgtaaaaacgccagactatttgggagcaggatcgccacacgattcggcatgctcggctgtgaccgcagccaatttgcggtttgagagacaagccgatcccaatcctggtacgtgatttgctccgattcagtctggatcgctacacggccgggcgatgtttcggcagtagatgaataggtatgagtaattgtcatgtagtgtcatcctccttttgtaaacatcgtatcagaaagagacaaggcttgagtgatttttatcgccagaaatgcagatacagccgcttttatcaaatcaccaggcacatatgcaaggctcatgaaggcggcctgtgacaaatcaatatgcatgataaaagcttgtaccggtataccaagcagataaataaagatgatgccgaatacgatatgagtgaaaaagagacgcaatactgtcaccttccgcagcctgttagcggctaaactgatcagccatgaagcgaggggataagcaatcaaaaagcctgcgctcggtccgaaaaacacaccaaaaccgcctcgtccgccgggcaacagcggcgctccgaaggcgacgagcagcaaaaagacaagctggcttaagatagcagactttggcctgagaatgctgcctgccaacatgacaccaagcgtttgcaatgtaatcggaacgggtgtaaaggataagaagagagggggcataaagccgagcactgccatcagcgcggtgaaaatcgcaatatgcatcatgtcgattaatttcagcatgtgaaatcctccaaacagtaatcaaatatggttatacaataaatgccggtaattattatgtcaactgatttttgatttaagtttacataatgaacgcaaaaaaaccggccgtatggcagaccggtttttgatggttattcttctgtcaggatgacaagcgaatcaacggaagcggccacatgggaaacggcgcggctgacttcctgaagccctccaagaaaggcttgcagatcgacgtcgattttgcctgattgctctttgctgattttcatgctgtggacgatttcatcgaataagcggttaatttgcgtcattttttctttactttcgctgactagctcattcacgtctttgatatgcttggatacaatgttgatttgtgtattcgtattgttcacaagctcagaaacagtagagacggtttttttcgtgtcctcagaaagcttccgcacttcatttgccacgacagcaaagcctttgccgtgttctccggcgcgggcggattcaatagatgcattgagcgagagaaggtttgtttgttcagctatgcctgtgacgatgccgaagattttttcaatttgctgcgcgatttcatccagcttgaccatttctttttcgatttggacaaggcttgtgtcaattttgttcatctgtttttgctggacttctagctctttttttccgccgatcgacttttcttcaacagtgctggatgttacagtgccggctttggatgcttgagaaatgccttcagatttgtccacaagctcttgaactgatctgcttgtttctgaaaacagattggcaatcgatccagaggtttcttgaattttctgatgaagaaggtttttcttttcttcttgttcatcacgggtctggttgtactcgctttgaaacgcttcaaggacaagctgctgttctaagttcaagatttttgttgttgctttaatggcttttagcagttcttgctgatttgtaatggacgcttcataaatgtcaatcattgacaaaagaagctcttgaaacgcacccatataccattttggcaaaaggccgattcttaaatggatggaggcgattcggttacgcttttcaataaattcatcatcgataacgcctgcaaacatttcctgaatatgccgttttaacgtttgttttaagcggtcaactgagctgtgatcattaatgatatccatcaatgagctttcatggtcaaggtttttataaaacgcatcaacgatatttacgatattttcttgaatgagtggctgaagctgctctaacacgtaaagctcagcatctcccaacctgaccattttgagctgttttttgacatctgcatgtttgtttgtgagctgaatgcggtttttttgctgtccgtttgaatctgaaaagtaagctgtttcttgttttctgtcttttttaaataacaatacaatgatcccccttgggaaaaatataatttttactttttggctttttaagcctttttcttttttatcggccaagggaaacatgaatgaagctgcagatgaaaaatatttgaaaaaacgttcattaaaatgaacggtttaatcgagatctatttgttttaatggtttaatggccggaccctctacaacttcgccagatggcttaaagcgtgatccgtggcacggacaatcccacgtatgctcactgtcgttccactcgacctcgcagcctaaatgggtacaagtcgtatcaacgagatggaggcagcctgtctcatcacgaaatgctcccgctcgcctgccgtttatggtgacggctttcccttctcctggcgaaatgtcttcaaattggacatcaggcttttcaagctttccttttatcaaatgcttggcgacatctgcattgtaggaaatcactttctgcaacccgggattcagatggaaacgggacggcgtgaaaatgctttcgtatgggttttcttttttctccacaaggtctgacaataaagtggctgcgactgctgaggacgtcatgccccattttttgaacccggtcgctactagaatattgtcctcattttccgacatcggcccgataaacgggattttgtcgatcgtcactagatcttgggtggaccaataatatggaatgctttcgatgccgatggtgctttcggccagttgtctcagtgtttcataatgtgtagacatggcttttccctggcctgttttatggcttactccgctgaagagaatcagcttttcaccgtttacaaccgtatagcggagcgccactgacggctgatcgatactcaaatacatgccctcgggatactcgatcttcggcttgatggcaaggacataagatctgtcggagtacattctcgcagcatataatccgcctccgtcataaaaagggaagtgggaacagcatatgataaagcggctcttaatggcgtgccggctttttgttaccacttcgggcctttcgccttttttgatatcaagcgcaacggtctcttcataaattcggccgcctttttgaacaatttgctccagaagcgcttttaagtattgaagcggatgaaattgagcttgattcttcatgacaagcgccagcttagaacctaagggaattggaagatccttgataaggtctctttcaattccgagctttgtgtatgcctcatgctcggtgtggattttttgaacagcgttttcatttgccgtataaagatatgcgtcttgctcggtccattcacaatcaatttgatgttcatccacaatgccttttatgtaatcaattgcgttttggtttgcttcataataaagcctcgcatggtttaatccgaaatggcggataaattcgtcgtatatcatgtcatgctgtgcggtaactttagcagttgtatgcgcagtggttccgttaagaacctgatttgcttcaatcaaaacgacacggaagcctctcttcgtaagttcatatgccgttgtgattcccgtaatcccgcctccgataatggtgacgtcacattcagtgtcctcttgaagcgcaggaaaagaaggcaggtcagttgatgttttccagtatgtttcaggtgcttcctttgcaaaatgttgattagccaagccgttatacctccaatcagatttattcttaatttttccatattctatcttttcatacataggaagcaggcattgttcataacataataaggttgaaaaggagtgatttcattggcgaatcaaaaaaagaaaacattaccgcctcagcaccagaaccagcagcctggttttgaatatctgatggacccgcgtccggtttttgataagccgaagaaagcgaaaaaattagagggcaaaaccgctattattactggaggagacagcgggattggacgcgctgtctcggtgttattcgcaaaagaaggggctaatgtggtcattgtgtatttgaatgaacatcaggacgccgaggaaacaaagcagtatgtagaaaaggaaggggtaaaatgcctgctgattgcaggagatgtcggggatgaagcgttttgcaatgatgtggtcgggcaggcaagccaagtgtttccatccattgatatattggttaacaatgcagctgagcagcatgtccagcccagcattgaaaaaatcaccagccaccagctgatcagaaccttccaaacaaacattttttccatgttttacttaacaaaggcagtgctgcctcatttaaaaaaagggagctctattattaataccgcttcaattaccgcctataaaggcaataaaacgctgatcgattattcagcgacaaaaggcgcgatcgttacgtttacaaggtccctttcccagtcgcttgttcagcagggcatacgggtcaatgcagtggcaccgggtcccatttggacaccgcttatcccggccagctttgccgcaaaagacgtggaagtgtttggttcagacgtgccgatggaacgcccggggcagccggtcgaagtggcgccaagctatctataccttgccagcgacgattccacatacgtcacagggcagacgattcacgtcaatggcggaacaattgtgaacggataataaaaagccaatccttgaaggattggcttattcgctctgcttgagcgctgcatattctttagagagcgtaagaaacgcatctttatctttttcgtccaaggctttgttaatttggtccgtcagcatggcaagccgacggttatacaaggattcatcgagcaccatttgaatgtaaatatccgtcattgtgacatcgaattcttttgttttttgcgtgttgcgggacttcatgagctcagtgtacgattttttctctttcataaagaatccccccaatgccttttttatagtatatggataacggtcgaaaaaatcaataaatttttataatttttagacaactaatacttggcaatctatcgacatatcctgcaaaatgccgtaaaccggcaagtcttatgaaagtaaaatcggtttattactagtcatttagtaccgttaaatatcattaaaagatgattttatcttaaatgttaaaaaaacctgtcgttttacaaaaacagatgatagattattagtataaattttgcagaaaaaggatggaggccataatatgagtcagaaaacagacgcacctttagaatcgtatgaagtgaacggcgcaacaattgccgtgctgccagaagaaatagacggcaaaatctgttccagaattattgaaaaagattgcgtgttttatgtaaacatgaagccgctgcaaattgtcgacagaagctgccgattttttggatcaagctatgcgggaagaaaagcaggaacttatgaagtgacaaaaatttcacacaagccgccgatcatggtggacccttcgaaccaaatctttttattccctacactttcttcgacaagaccccaatgcggctggatttcccatgtgcatgtaaaagaattcaaagcgactgaattcgacgatacggaagtgacgttttcgaatgggaaaacgatggagctgccgatctcttataattcgttcgagaaccaggtatatcgaacagcgtggctcagaaccaaattccaagacagaatcgaccaccgcgtgccgaaaaggcaggaatttatgctgtacccgaaggaagagcggacgaagatgatttatgattttattttgcgtgagctcggggaacggtattagaaaaataggaaggagctgaccgaacagggcagctcctttcataaagctatgccgtcggaattcctccggtgatgccatatacctgagatgtcacatagcttgaattctctgaagctagaaatacataaacatcggccaattccactggctgcccagcgcgatttaatggagctggcggcgtgccttgtccgaatttcgggatgttttccgtcggctgtccgccggaaatttgcagcggtgtccaaattggtccgggcgcaactgaatttactctgatgcctttggaagcaagctgttttcccagtccgacggtaaagccgataatggcgtttttcgttgctgcgtaatctaacagcatcgggcttggattatagccttcaactgaggtagttgtaataattgaagctccctccggcaaatacggaagcgccgcttttacaacccagtaaagggaaaagacgttcacttcaaatgttttatagatttgttcagtaggcagatcttcgatgttttcgaccgcttgctgtttgcctgcaacgagcgctagcacatcaagtccgccgagttcgtgatgcgactgtttgactagatcttggcaaaaggattcgtcgctcaagtctccggggatcagcactgcttttcggccttctgcttcaatcagctcttttacctcttcagcatctggctgttcctcgggcaagtagttaatagccacatcggcaccttctctggcgtaagcaattgcggcagcgcggccgataccggaatcgccgcccgtgacaagcgcttttcgacccgttagtttacctgatcctttgtagcttttttctccgcaatcagggacaggtttcatgttcttttgcaggcctggcggttcttgatattgttcgggaaattcatcatgaaaaaatgcttttataggattcgtaagatttgaatcagacatcagcaacgctccttttctgtttggtgtacattcgtatgtgtacccctgagcataagcagaaaaacatgttttggcagtttgaatagtgaaggaaaaagaaaacaagaaaaaacaaagccttcttccatatttatcttgtcaaataagactatatgaattatgataaattcgagctataaatcaactaaatattgggtgttgggagagtgaatcgtcatgaaaaaagcggcggcggttttgctgtcactcggtctcgttttcggtttttcatacggagctggccatgtggcggaagccaaaacaaaggtgaaggtctataagaactgcaaggagctaaacaaagtatacaaaggcggagtggcccgcacatcgaaggtgaaaaacaaaggcggaaaaacgaagtacaagccttacgtttctaaggcgctttacgatgccaataaaaacaaagaccgcgataaagatcttatcgcctgtgaacggtaaataagaaaaagcaatctggtgtccagattgctttttctattgcttaagccgcctgatcggccgcagcgcttttcgccttccttgtcataaggctgactgccatcatgaccgtgatattcaaaagcagggcgacgatgccgacattcaagtcttttgcggcttgcggcagagccggaaataaagtgccgatcgtcgtttccgtcattgtaatataagtaactgctccgacacctgcaataatgccggcgaaagctccttgctttgtcaccatattatgcttgagcaggctgaacaaaagggcggggaatagctgtgtgacaaggctgtagcccatcaaaagcagcgtaacgatggtattcccgcctttgaaggtaaaatacaccgaaatcagcgcaatcaccggcactaaaaacttagcaagcgccgatacttgctgttctgtcgtgcggggcgcgattaccttgtacacattttttgcaaacagtgtggaggcggacattaagatcatagaccctggcacaagtgctgtcagcagtccggcagcaccgataattccgacaaaccaagggtcaaatgcttgcagagacagtctcaaaagcgacaaatccccgtctgcgccattcagatctggaacttgcaggatagccgcaaagccaacgaaaagaacgaagagcaggaccagctggtacaaaggcatgatgatggcgtttttacgaaacacttttgggttttcggctgaatacgaagcggaaaacgtgtgaggccacatgtaaaaaccaagcgctgtcaagagtacggttgaactgaaccaggccacactttgtcccgattcggggagcgtaagaaagccaggctttgccgtttcaatctgctgaaacatgtcttgaaatccgccgtagtaatgaattggcaaatacacacctaaaaacagaacgacaaccagaatcatgatgtccttcacaaccgatatccaggcagacccgtgaatgcctgaaaccataacataaaccgtgatggaaacagcgccgatccagatggcggcggtcggggtgattttgccgtacgaggtttccgatacaatcagcccgaggcctttcagctgcagtacaagatagggaatgagtgcggcgatgccgaccagtgaaacgagaatgccaagcagcggactgttgtatttttttgtgaaaaaatcagactgcgacattagtttatgctgtttcgcgtacgtccaaactgctggaagaagccagtaagaaaggatgtaggccagacatccgtaggcgatgatataaaaggctggaccgccctttccgtaggcccagccgctgccgccgagaaacgtaaaagtagtataaatttcgcctgccatcaaaaggaagacgaacacagttccgaagccgcgccctccaaccgtccactgctccaggttcatgtcttttcctttttgggcgcgtataccgagaaaaatactcaagagcaggacaccgaaaatgatgatgagagctgcattcattctgcttcctcctttttattttccttgtcgaggacatacacaatcgccatcagcgcagaggtcaaaagagcccacatcacaatataggcaagaataaacggcatgccgaacacgtagggggtcaccttatttgcaaaagggatgccgagtaagataccgataaagggcaaagcggcaagaacgtgaatcagtttcatagaatcctccttctatttaggattggggtgtacaagcccaagcgtactgaaaatgatgtcgcagatatggcagcacatgtcactttttagggtgaaaggctgtggttcgaattataaataaatttattttgtttgtatagtgtgaattgtctgaaattaatgctctgaatcgcccgaagagggaacgggcagtatgattcaaaaggctcggagtctgtccggggcaaatagatagtatgttaataattcgctgacctgctcacggattcgcggattaaaatagcgatggttttcttcataaccgtcgatgacaaatgtatagagcgtaaaggcttcatcgcgttccgtctcgcggattgcaatttttcttttcctcagttcttttctgacctccatcaaatccttttgtgctatttttaatgattcgctgataagctgtttataaggatgcttcaattttaatgtgctttcttcaattccggcgagatcacggttaaaaatcgtaatggccatgggcaaaaagagagcccgttcaattaaatcgtatatttcctcctgcagatttggcatgttgactccttctttctaagggaacgtttgttctatttgtattctatatcggctggtgaaatgtttcaagacagaaaaaatcaccaaaactttttagttttctgctgataatgtgtagaataaggatagacaaacccggtaaggagtataaatgttggagcattttttatcctatttgacacaagaacatttaactgaattatttcaaagctatagggctttcggtccgctcatagctgtgctgctgcctttaattgaagcatttctcccgtttttgccgctgatcgtgtttgtggtggcgaatacgaactcgtttggcttgtgggaaggattcatcctgtcttgggcgggatcaactgctggttccattctcgtatttttgattgtccgtcaatacggacagagaaaattgcttggatttatccgcagtcatccgtctgtaagaaagctgatgttatgggtggaaagacacggcttcggtcccatgtttcttctgctttgttttccatttacaccgtcagccgcggtgaatgttgttgccggtttgtcaaggatcggaacgcggccgtttattttggcggcagcctcggggaagcttgtcatgatttttatgatcagcttcatcggatatgatctgcacgcgctgattacacagccgattcgaacggtcatcgccgtattggtgatcactgtcttatggtatgtcggcaaaaaggtggagcggtatctgcatgtaagagccagtcagcgtgagcatgatggagggagacagtaacatgaaaaaacggttttggtttcttgccggtgtagtgtccgttgttctcgccattcaggttaaaaatgctgtctttattgattacaaggtagaaggcgtcagtatgaacccgaccttccaggaaggaaacgaattgttggtcaataaattttcgcatcgatttaaaaccatccatcgttttgacatcgtcctttttaaaggccctgatcataaagtgctgattaaacgggtaatcggcttgcccggtgaaacgatcaaatataaagatgatcagctgtatgtgaacggaaagcaggttgctgagccatttttgaagcatttgaaatctgtttctgccggcagccatgtaacgggtgatttttctttgaaagatgtgacgggaacaagcaaggtgccgaaaggaaaatattttgtcgttggagataatcgcatatacagcttcgacagccggcattttggtccgataagagaaaaaaatattgtcggtgtgatttctgatgccgaataaaaagacgctaatggaagaggcgtctttttgtatgccgtttggaaaaatgtgttgaagaaaaatttgtaaggagctataatcaaaattgttacctgtgtaacaaaatttatatattttttgattggaggtccgtttttattggtttttgttcgttttgtatgaaacaaaaggagtggtgaatgatgatgaaatatgaagcagtgattataggaggagggccggtcggatttatgctggcttctgagcttgcgatggccggagtgggaacatgtgtgattgaacggcttgaaaaacctgttccgcattccaaggcgttgacgctgcacccccgaacgctggagcttcttgagatgagagggattttagagcggttcgtatccaagggaagcaagatacctaccggacatttttcaatgctggatacccgtctggatttttcaggcttggatacgagctgtccttacacgcttttgctcccgcagtcaaaaacagaaaagcttcttgaagatcatgcacgaagcctgggaacagaggtgtttcggggtgccgaggcgctggcggttacggaaaacggggaagcggtccaaacaatttttaaggatcgggacggcagtgtacggacgatcacaagcaagtttgccgttggtgcagatggcgccggaagtaccgtccggaaacaggcaaaaattgagtttccgggaacagacagcactgtcaccgctgcgcttggggatgtggtgctcctttctccgccgccgtcaggcgtgctgtccctttgcacaaaagagggcggtgttatgattgttccgttatcttcagaccgataccgtgtcgttgtgatcagtccttatcgcacacaaatgccgaaagatgtgcctgtgactgagaaagagctgagagctgatctcctgcgaatttgcggaactgacttcggtttaacagacccttcgtggatgtcgcggttcgggaacgccgcgcgccaagcgaaacggtatcgggacggcagaatctttcttgcgggtgatgccgcgcatattcattttccagcgggcgggcaaggactgaatgtcggccttcaggatgcaatgaacctcgggtggaaactggcggcggccatcaaaggctctgcgccttcttggcttttggacagctaccatgacgagcggcatccggcagcggaagggctcctcagaaacacggaggcacagacaaagctgatcgatttcactcaagcaggcctccatttgcgaagcatgatgtcggagctgctggccttccctgatgtgaatcgatatgtagcagggcaaatttctgcactcgatgtcagatatgaagctgatcgtaccatgccgccgaatcgtttgaacggggcacggctccctgacatgaagctgattctttccgacggcagttcggaatggctgtacagctttctccaaaacgggtcattcgttttgctgtcattgaggcaggaagctgatgagcatatcgaagtgaaaggcttacgtacggtaaccgcctcgcttgcagaaccgaatgaaaagttgcgggatgtgcataccatattggttcgtcccgatggacatgtagcctgggcggtggatgcatcagcgcccgattgttccgaggtgattcaaaaagggatcagccgctggttttccgtcaccagccgagtataattcaattcgattgtttcatctgtaacaaaacggtatgatagaagaaacaatcgaatgaaaaaggatggaaaacccgatgaacacagatcatacgaaacgcaatctttttgaattgtatgcggagctcattcatcaacaggagaaatgggaggggcttattaaagcctttttatctgacgaattgaggaagctggatgtagagcacgggagtaaatctcaattgacgatgacagaaattcatgttctatcctgtgtcggggacaatgaaccaattaatgtcacgtcgatagcagaaaaaatgaatacgacaaaagcgactgtatcacgcatcagcacaaaattgctcggcgcaggcttccttcacagaacacagctcagcgataataaaaaggaggtctacttccgattgacgcctgctggaaaaaagctgcacagtttgcacaaatattatcatcagaaggctgaacagcgttttctgtcattttttgaccgctataccgaggaagagattctttttgcggaacggctgtttcgggatctggtgacaaaatggtatccgtcgtcagaagaaattgaaggggggcttcctagcatttttaaataaaaaacacgcactgaggtgcgtgtttttcgcttttttctatcttgttcaaggctgtaacgtaaatcagatttcatcttgaagaatgaaattcaagatgttctggaatttgcactgcttatacgatatgtctattagtatctttattttatacgttttttactgtgtttttgatgctttgttttcaaatgaaatagggtcttctgttttagttctcctaatctttacagaaatacctactagaatgaccgccatagttgtaaatattcccatggttaataagatcgtatcctgatttaaactccatccaattaagaaagagatgatcgctcctccgaaacttgccgaagcaataaataaacttgtaacttcgtcaacgtacttctgaataatgattgatgctagtgttaaagcaatgggaaatatgcccgctatacttaggccaatcaaaaatgtaccgcccaattgaagtattgggttacttatataagagaaagcaatcaacaaaacaattaaacaactacagctaaaaaggaggtatttagaaaaatcaagccttctacttacgaaaccaatcaatattcttcctatgatgatccctacccagaaaaaggagacacttataagactaatttgttcattgtcttggtttatcatgattgaaggtaaaaagttggcaaaatttgtttcaattccagcatataggaaagcgaaaaatacaaaaaagcctaattgctttgatttttttctatctcctataaagtattgaaatgctcctccatctggaaaggtcacttgttggttagcattcttagcgtactctcggttcttagacaagaaaattaaccaccctacgaataggacgaataaaaaggtgaatatacagtaatacggtaaaaaccagttattgatatctatgaaggaattaattaataatgggaaagataaagcgcctaatccaaagagaacttccagcttactcattttttctgcattactttcgaaattagcaataacaaatgaaccaactgtcgtttctaatgtgcctgccccatatcctaagagaaaagccattacaacaatataataccaatccttagttagaaaaaagatacttaacgctgcaagcattattgtcaaagctaaagtaagtgtcctaaaatgactgtatttcttaatcattaacggtgcgattaatactccgcttagaaatccggtaaactgaaagaagattatgaccgaaatatcatctgttgtcttgttaaaagactctaatagaaatggtgtcaaactccctgttgatatatggataatgcctactgtaaaaaagaaagcatatccaaataaatatgtccctcttaacattcattacacccctatatgaaaaagcaggaaaataaattcctgcttttttagtaacttctctcttcgaaatactagttgactgctgaaacagacattggttgagagttgctgtctttctcaaagaacatttctaatacttcctgagatctaaaaccatcactaaaagaagggatctcaacccaatcattctgagttgatgcaatccaattgattaactcgcttctaaaagaatcagcccatccataaaactcgtttggcggatcgtttaataggctttgcggtactgggcagtctaccacgttcaagccatctatgagcttgtaaacgtgaggattacctgtgtggtatttaaactcttttttgtgtccaactacctcaatgctaaaaccacagtcttcaggtacagaacattttgatgtgatgatatttacaaataccttgttcttcagctggccataaatttctgcatagtcatctacgagtacctgtttatcctcttttgtttttacatttgtgttcatttttgccgttactgattctgtgatgaaatcactctcaaacaaataccataccatgtcaataaggtgaatacccagatcccccaatgatccactcgtcttcttactgttagcgtcatctctccaagtaaacttcttacgcctaagtgcactatttttcttgaagtgtacttttatggacagtatgttacctagttcattattgataattaagctttttaagatatttacgtaagataaatatctataattaaatcccatactggctcttacgctcaacctttcagcagtatctttcattatgcttgcttcttcaagagaaatagccataggcttttcacacaaaacatgcttatgttttcctaatgcttgcaaagcatgttctttatggcaaaagtttggtgatgctacaattaaaccttctgaggcatcaattagttcatctacgttttcaaatgacttcccgccgaaagttttcacaaagctttccgcattttgttgatttatgtcatatacccctactaactctgcattttttattgtagataaagcagttgcatgcgctcttgcaataccacctgcacctatgatgcctatcttcttcatttttatttcctcctcatgatccaattaatttttttaaggtattagtaattccttttgagtactcactatcagttataaggtggtgcaagttttttgcttcctgtgttgcattttttagcagatatccattccctactgtctgtaacatacgaacatcatttccactatccccaaatgcgatagctctttcggtatttaggttgtatttctctaacataaacgttacaatttcattctttcctgtccctgtggggataaaatctacatcatagctgtcttctggatcgcctgctaagggattacaccgatttatatttactgaaacgccgtattcctcgcagattttttcaattgctaataggtttttcttgtcgtttatttcatcttgttcctgatagtagaagttatgcttataccgtgactttcctaattgagtttgaggattcaaaagaatgttatgattttcatgtagctgtttcacaagtttttcaaccttttctttactaaacccttcattaatgcgactgttccacttgttatcttgctgaccgaagttatgctctgaaaagtacgtaatttcagttccaagatcactagctataaaatgcggaaaatatctaaattttcctcttcccattttatcgagaatagattctatactgctcccagtaacccatccgattattagcttcccatctttacttttttgttctagatagtcttcgagttcatagatgtcttgttgcttttgttcgtcgattgtatgcggaaaatacgtttcatcaaaatcacaaaaaacaatatactgaggatgttcaaccgtggataacgttttatactccgatttcttgcttaataacatgaaacagtccctccattactctgtcttgttcttctaaagtaaatgacggatataaaggcaaatgcagtacctgactatgagccttttccgtatgaaccaattggagtcctgcatacttgtcctgtactaaaggagttttttgcatatgagacagtattggataatatacatctgtttgaacaccaaaatcttcatttaatttagtcatgatatctgcccgatcttctgttcttaccttaataggaaacagatgccatacatgatcttcacttaattctggtaattcaatatagcctttattctgcaactctgctaattgggtaatgtatctatccgccaagaacaatcttttgaagttgtttaatgaaaggtacttcattctctctaaaccaattgctgcctgtaaattgtccatttttgaattaaatccaaaattgatgactttcttattttttacatttacttcaaaaccgtgataactaaattgaatgcattttttagcgagttcttcattatcagttgctattgccccagccttgccacatacaccaaaattcttatagggattaaaacttaatgtagtgatgtctgcatactttcctaagtctgtcagtccaattccttggcaggcatcttcaattactttcaatttataacgatttgcgatttgacgaatatgctgcatgtctgaatgttttccgtataaatgcacaggtagaataaactttgtataaggagttattgcttcttcaattttgtcaggatcgatgcagaatgtttgtgggttaatatctacatagataggaacgcctcccaaagctaacacagcattttcagtagctgaaaagctattagccggcatgataacttcatcccctgggtttaatcctaaagccaataaacctatcataatagcatcggttccactgctggttgcaattacataccttttatgtaaatatgtagataaaactttttcgaattgctctaaataggaaccactcgtaaattttccagttggcaaaacttcagttaatgtatttaagatatcttccacttcatcattggttattaatctgtctacaggcaaaaaagggactttactgatttcacgatttttttgatagttgaaaagatcatgttcaatatctatcttttcttttaatacttgtttccaccgctcgtttacaatactgtcttcaataacaagttcttttccttgtacgtcaccttttaagtgttttaatagtgacatgttttctttgcttttacctgaaatcttaacctgtttttgcatgaacagtacctccaatgattttataatctaaaaatttattacaaatttatcctagtttctgaaatcggtaacatgtcaacaacttttttaaggaagggaaaatatgcctacaattgatgaaatagcaaaattatgcaatgtgtctaaaaccacagtgtcaagagtattgaataatcatccttatgtgtcgaaagaaaaaagagatatgatcttaaaggctattaacgaacttgactacactcccaattatttagctcggaattttaggagaaataagacacaaacgatagctttatcggttccgagtatcgaccatccattttttgctcaattaataaaaggggtctctcatgaagcactgtttaagaattacaaggtaattgtatttcagaccttttatgacaaacagacggagctagaattactagagttattgaagcataaagaagtggatggcattattcttgggactttagaaaatgaatgggatcagatatcccctttcttaaagtatggtcctatcttattatgtaatgaatatcatcactcagcggacatcacgataattgggtatgatgaatttgaagctacatacatgggggtagtacatttaattgaaagagggcataaaaaaattgggttttgttttgatactccatatagcgaagctcaatgtcagaggaaagagggttatttgaaagctttacaagattacgatttacatcatagaagcgaatggatattcggcgaaatgtttaatatcgaggatggctttcgtgtttttcataagataaaggatctaaaggacagaccctcagcaatatttacaggaaatgatcaagtcgccgcagggattattaaacaggcgatgaaaaatggctttaaagttccagaagacttagctgtaattggttttgacaaccaattgatctgccaagtcgttactccgaccataacaacaattgatatccccgtaatagaattaggtcaacaggctgtgttgaaaatcatcgagtccatttcgggtaatgccactttaaacagaagaattattaaactgccaacaaagcttattataagagaatcaacgtaacgatagatttccctttatcattttatatctttatataagaaaaagaggttattcattttaacctctttttcaatcgtaagtcgtcaattatttctttcatttcaccctctggcagcattcacttcaaacctgatccattaacaacgaaatatccgcttatatttcctcatctcgatggtttgcgaattaaaagttcttgaacccttttttcaactaggcactactgccgctgattgagctctttttgtcttttttttcaccatgaagatggtgaagcaggcgataaaacggcggcagcagggcaataaccagaatgacgcgaatgacctgaaccgcaacgacaaaggtggaatcagcatgtaaggtaacagacgtcgtcgccatctctgcaatcccgccgggcgcaaatgccagaacagaagtgatgagcgaaattcctgtcagctcggaaacgatcacggcgctcaaaaacattgctgcgattaaaccgacggacgagacaaacccgacgatgataatacgggtgacgccggcaaacatgcttttatacatcttagagccgatcgttgccccgagaaatacttgtgatacatggttagcttgtgacggccaccatgccgtcatgtcgtgccctgtcaccgcagctccgccaacatgtacaattgctacaccgagcatgctgccgagcagccatggagctggaaattttaaaaatttcgcagctttgcaagctccccaggcagcgagaataagaatgacggtccacaaaacgggagcgagcctaaaatctgtcgttgcagaagaaatcgtctctgctgcggcacttgcggtacgatcttgttttgtatagatcagaatgactaaaaacggaatggaaagcaccacgagcagcacacgcatcatttgaacgaggctgactattgcggtattggcgcctacttcctgtgcgatgctcggcatggcggaaagcccgccgggagcggtgccgacaaagctagtcatcatatccgttttgctgaaacgccaaagcacatatcctgacagcatggccagcaggatagacaatatcagcataacgccgactgaaaaccaatggtctttgagaacagagagaacggataaattcagcttttggcccaattcaatgccgaggatcatctgcccgagggcgagccatcgtcggttaattcctttttggtctggtgccatcatcagccatgccggccgtatcatggcgaggcagcaggcgacaatcagtgttccgatcatccatccaattgatattccggttaatgaaagaataaaccccccggctgcactgattgcgataaaccatagatctttgaggagattttcgtctttcttcaatgtaaaacccttcttcctttttcacgtaacactccaattgttcacgtagtgaatgtatttattactatagtatatttttgttgataaagaaattatgaattattttctataagcgattcacttttcttatgaccttgtgttcgagcttttctattgtgtaagtcagagataaacccgctgtcagcagacacacggcaagagcgtaaaaaatcacttctccgccaaatgatgtcaggatcagcccgcctgccagcggtccgattgagcgggatatatcccaatgcagaccatagacagcataaaaccggcccagcaaatgaggcggcgccaatttcgatatgaaggtctggatgtgggttagcccgatgctttcgccaaccgtcatcaccgctgccgtcactaaaagcattgtcagggaggttgagcatgcaaaaccggcagccgcaagggagtagcaaatataagtaatgaaaaggattgttttcattgaaagcttttcggtccctttgacaagaggtacttgaagaacacagctgaataaagcttttgctgctgaatagatggtcagcatggacagataatcagaaaacatgtttttgctgaacagcctgtatgttgtttctgattgtgcatataacatgctgatggggagagaaagcagcaaaagaagcaggacaggcctgtatatcgtaaagctcgcggacattttcggggtaacagctgggtgtagcggctttgtctcaggcagtttcagtgcagcgatcagaaagtagataaacaatgccgcagcatctaatgcgaatatccacacggggttatgattgtacagcagcatccccactagcggtcctgccgtcagacccgctgaatagatcgcattgatgaccgcaaacacttccgaacgtctgctttccggcgtgctttcagcgatttgggcgcgggaagcgggaatgtacaacgatcttccgatgccattcatgacatagagaatagcgaaaacatacgcatgctcagcaaatataaaccctgtcattgccgctgattgaagaagcaatgcggtcaaaatcgctgtgcgccgcccaatccggtccgccgcctttcctgcagcgagcgtcaggaaaatatcagcaaatggctgaaggctgatgatcagcattggcatcatgatactgccgtttaattgttcatgcagatacagcaccataaaaggtcccatcattgcacctgtcaggcttgtcagcaattcgccgaaaaagcggagccgaacgggagcggtatatctcgattttatagagtgaaaactggtcaacatgtgatcgccgcctttcgctgtttgatatagtagtagtgtatagaaggggcggcggcccaaaaagtgaagaaaagaagagataaaagttccccttttgtcgggaggtgcggggattgaagctgatagagcactacgtggcgcttgtaaaaacaggctgcgccgagtatggacaaatgaacgaaatgacactcactgagattgccgactgtttattttgtacagaaagaaatgcaaagctcattttacataagctggagaacagcaattggattatccggaaaagcggggcggggcgcggccgcaaatctaaaatcgcgtttcttcggaggcctgaggaactgcttcttcaaactgcaaaggaatataccatgtcaggaaagcttaaaaaggcaaagaagctgcttcagcagtatcagtccgcgtttccggggcttcaaaacgaatataacatgtggctttcagaggtattcggatttgtgacggagacaggcgagaatggggcgaaggatgttctgcggctgttcatcacgcccgaatctgtcagcagtttggatccatgccaaatatttttgcggtctgagggccatttcgtcaaacagatatttgatacactcttcacgtttgattcggatatgcaggagccaaagcctcatttggttcatggatgggaagaggtcgaaaaaaaacaatggagattttttcttcgaaaaggtgtgtcatttcataatggacagccgctgacatcgcgggacgttgcgtttacgtttcagcgctttttggaactgggtgacaacccgtataaatggcttctgcacggagtgaaacaagtcttagaaaagggcccttattgtgtggcgctcatactcgataggccgaatgcgcttttgccgtatgctctttgtgatgaacggctgtccatactgccggcagaacagggcggcgggaaaaatggaacagggccttttcaggtgaatcagcaacacagcgggatgcttgtgcttgaagccaatgagcgctacttcaagggacgcccctatttggatcgcgttgagtttgtgttttctgagcaagccggagagatgaacggttttaccattcaagaaaaacaaacatgtcctgagcagcaaactgtttttgatgagcggcatgttcagtatttgtcgctcaatctgaaaaagaaggggcctcttcagcaccaaagctttagaaaagcgctccggctgctgatttcctctgaacggctcgttcgtgaagcgggagggcaccgaagaatcccggttacgtcctttttgcatccgagttcttttgagtgggagggcgtttcgccatctgaattgttgaagaaaagcggttacgagggcgaaacaatcgtgctttataccttttcggaaacggatcatcgtgaggacgccgaatggattcaaaatatttgcgcccagcacggtatcaggcttacacttcaattctgtgatgctgctgatctgcgacggccggaaaccgtgcagatggcggatatcattcatgacagtgcgacgttttatcaagacagcgagtttggttttctgcatttgctgctgtcggagaacagtttcttgtatcagcatctatctgaaaagctgacacagatttgctcaggaatgatagagcggatgttttccatgcctgatcgctgttcgagaatcaacatcctgcgtgacattgaccggcagatgatacaggagctgaacgcgatcccgctgtatcaaaatgtgctccaggtgacatcaagtaaaaatgtaaaaggcctggtgcttgatgaagagggatggattgatttgtactccgtatggctgtccaaataaaaagagggttcttttttgaaccctcttttttaaactgccatgctgcggcattgttcagcacaggcgaagcaggctttcgcacatgcttggcaatgatcatgatcgtgctttccgcattcagtgccgcatgcttcacaaatatcggcgcaaagtgcacaaatttctttcataaacgggctgtccgtttgcatggctttgaccgccagcgcgcaaatatccgcgcattccctgtcaagccggatgcagccgctgagatgatgctgcacgctttcttgcaagcatttagtgaaacaatgattgcaagccttcatgcaatcgatgcaagcctcaatacaagcttcagaatattgctccatggttgattccccctgtatgacagtatatggttttatgtttcccggctgcatttgaaaaaaacaggggagtgtgtttttagctaaggggatatgtacatataccctgaacgggtatatctaaccatcagatagtataggaaccagacagcgtgattttgttcatcacgtgctgcgcgcgtaaagacgcctttcgcttttaagtttgacgtttcctcggccgcacgcaagtaaaagtcgacggtttcttgttcatctttaaaagcggcatccagtcctcttgtgaaattgtccgggcattcttccgtttgtttcggcatgatgtgtttgccggtaattgaaccatacagtgtggaaaattcacggaggtggcgaatctcgtcacgcctgatttcttcaatctgttttctgacctcatcgctgtgggcgagttcggcgagcttgcggtagcattgaatggcactgaattctccgttgatggccttctgcaaatttcgaatcaaaacaggatcttccctgtatggcaccggatagggatagtagctgtaatgcaaggggattcaactccattcttaggaattgggcttctgtaaaagtatatgttgggcagggagagatgtgcggagataatcagctttttatatgtgaaaaggccgtttttaccaatagatcagattggtcattttcgtcaacattcgataaaatatatagagataaaaagagaggggtcttctaatttgggagcagagtttttagtaggcaggtccgggagtggaaaaacgaagctgatcatcgacagcattcaggatgaattgcgccgggctccattcgggaagccgatcatttttctagtcccggatcaaatgacgtttttaatggaatacgagcttgctaaaacgccagatatgggcgggatgatacgcgctcaagtgttcagtttttcacgattggcctggcgcatcctccagcatacgggaggaatgagcaggccgtttctgacgagcaccggcgtacaaatgctcctgcggaagctcatagaggagcataaacaggagttcaaagtctatcaaaaagcgagtgacaaaagcgggtttaccgcacaggttgagcggatgctgacagagtttaagcgctattgtctggaaccggaggatatccgccggatggcggaaagcggaacggcttccgagtatcgcggagaacgtgttttatctgaaaagctccatgacttatcaattctgtatcagcaaatggaaaaaagcctcgcagatcaatatcttcactctgaggattatttgacattgctggcagagcatatcccgcttgcggaagatataaaaggcgcccatatctatgtggatggcttttatcagtttaccccgcaggaattcagggtgttggagcagcttatggttcatgcggagcatatcacgttttcgctcacagcggacaagccgtcatatgagcgggagccgcatgaactggaattgttcagaatgacggggaaaacctattaccgcctgcatcagaaggcgaaggaactgaatttggacattacgtataaagagctgagcgggactgagcggcatacaaagacgccggaattggcgcatctagaggcacagtatgaagcgcgtccggccattccatacgcagaaaaacaagaagcccttactgtgatgcaggccgcaaacagacgagctgagctggaaggcattgctcgggaaattcacgccctagtcagagagaagggatatcgctataaggatgtagcaattcttgcgcgccagccggaagactacaaggatatggtgaaggaagttttcgcagattacgagattccttatttcattgacggaaaagcatctatgctgaaccatccgttaattgaatttatccggtcgagccttgatgttctgaaagggaattggcgttatgaagcggtgtttcgctgcgtgaaaaccgaactgctattcccgctcaatgaaccgaaggccaaagtgagagaacaggtcgatcagctcgaaaattactgtatcgcctatggtattaaaggcgaccgctggacaaagggcgatcggttccaatacaggcgttttgtgtcattggatgatgattttgcgcagactgatcaggaaatcgaaatggaaaacatgttgaatgacacccgcgattggattgttccgccgctttttcagcttcaaaaacgcatgaaaaaagcgaagacggttcaagagaaggcggaggcgctctatcgttatttagaagagacggatgtgccgctgaagctggatcaggaaaggcagcgtgctgaggatgacggcagaattattgaagcgcagcaacatcagcaggcgtgggacgcagtcattcagctgcttgaggagtttgttgaaatgatgggagatgatgagatttctcttgatttgtttcagcaaatgatagaagccggcgcggagtcgcttacattttctctaattccgcctgcgcttgaccaggtgtttgtcggcaatatggatttgtccagaatgtatggcacctcctgcacctttgtgctcggggcaaacgacggcgttctgccggcacgccctgatgaaaacggggtcctgtcggatgacgaccgggaatggctgaaaacgattggggttgagctatcctcaggcggacgagagcgtttgcttgatgagcacttcctcatctacatggcgttttcaagtccgtctgaccggctttacgtatcgtatccgattgctgatgcagaaggaaaaacgcttttgccgtcgatgatcgttaagcggctggaagaactgtttccgcatcataaggagcgcctgttaacaaatgaacctgaacaggtcagcgatgaggaacagctgatgtatgtcgtgaataaaagcgtggcacagtcctttaccgcgagccagctcaggttatggacacgggaatacgacatcagcgacgtctggtggagcacgtacaatgtgctgatgagtgagccggacaggctgcagtcgaaaaagctgttctcaagcctgtttttccggaatgaagtgaagcagcttgaacgcagcgtgtcgagacagctctatggtgaacgcattcagggcagtgtatcgagaatggaaacctttaacgcatgcccgttttcccattttgcgtcacacgggctgcatttgaaggaacggcaattcttcaagcttgaagcaccggatatcggccagctgtttcattccagcttaaagctgatttctgataggctgcgtgagcaaaagctggattggcgcgatttaacgaaggagcagtgcgagctgttttcctatgatgcggtagagcggctggcaccgaaactgcaaaaggaaattctgctcagctcaaaccggcattattatgtgaaggaaaaactgcaaaaaattgtgacacgtgtgtccggcattttaagcgagcatgcgaaagcgagcggattcgtaccgatcgggcttgaactgggctttggaggaaaagggccgcttccgccgctgacctttcaactgaaaaacggctgtacgatggaactcgtcgggcgaattgaccgtgttgataaggctgaaagctcaaaaggcctgctcctcaggattgtcgattataaatcaagcgacaaaggccttgacttagcggaagtatattacggattggcactgcaaatgctgacgtaccttgatttatcgattacacattcagctgactggctcgggatgagggcgacgcctgccggagtgctgtatttccatattcatgacccgatgattcaatctaatctcccgcttgggcttgacgagattgaacaggagatctttaagaaatttaaaatgaagggcttgctcctcggtgatcaggaagtggttcgcctcatggatacaacccttcaagagggacgttcaaatatcataaacgccggcttgaaaaaagacggctctctcagatcagactcagcagcagtcggtgaaaaggaatttgatcttttgacaaagcatgtgcgccgcaccttccaagaagcgggcgaacaaatcaccgacgggcgcgtatccattgagccgtacaaaatgaagaacaagacgccgtgcacatactgtgcgttcaaatcagtatgccaatttgatgaatcactggaagaaaacgagtatcgcccattaaaggctgaaaaggacaagacaatacttgagtggataaaaaaggaggcggatggcaatgaacattcctaaaccggcagacagcacatggacagatgaccaatggaatgccattgtttcaaccggccaggatattcttgtggcagcggctgcgggctctggtaaaaccgctgtgctcgttgaacgaatgattcggaaaatcaccgcggaggaaaacccaatagatgtagaccgtcttctcgttgtgacatttacaaacgcctcagcggcagagatgaagcaccgaatcgcagaagccttggaaaaagagcttgtacagcgccccggctcgctgcatattagacgccagctgtctcttttaaaccgggccagcatttcgacgctccattccttttgcctgcaagtgctgaagaaatattactacttgatcgatcttgatccgggctttcggatagctgatcagacggaaggcgagctgatcggggatgaagtgcttgacgagctgtttgaagacgaatacgcaaagggcgaaaaggcgttttttgagcttgttgaccgctatacgacagaccggcatgatctggatctgcaatttctcgttaaacaggtgtacgagtattcccgatcccatcccaacccggaggcgtggctggaaagctttgttcatttgtatgatgtatcagaaaagagcgccatcgaggagctgccgttttatcaatatgtcaaagaagatattgcaatggtgcttaacggggcgaaggaaaagctcttgcgcgcgcttgagctgacgaaagcgccgggcggcccggcgccgcgtgctgacaattttcttgatgatcttgctcagattgatgaactgattcagcatcaggacgatttcagtgaactatataagcgggtgcccgccgtctcttttaagcgtgccaaagcagtaaaaggggatgagttcgatccagcgctccttgatgaggcgacagatttgaggaacggcgcaaaaaaactgcttgaaaagctcaaaaccgactacttcacgcgaagtcctgaacagcacttgaaaagcctagccgagatgaagcctgtcattgaaacgctcgtacagcttgtcatcagctatggaaaacgattcgaagctgcgaaacaggaaaaatcaatcatcgatttttcggatttggagcattactgtttagcgattttgacagctgagaatgacaaaggtgaacgtgagccgagcgaggctgcaaggttttatcaggaacagtttcatgaggtgctcgttgacgaatatcaggataccaacctcgtgcaggaatcgattctgcagctcgtcacaagcggtccggaggagactggtaacctgtttatggtaggagatgtcaaacagtcgatttatcgattcaggcttgcggagccgcttcttttcctctctaaatacaaacggtttacagagagcggagaaggcacggggcggaaaatcgatttaaataaaaatttccgaagccgggctgatattttagacagcacaaactttttatttaaacagctgatgggcggcaaaatcggtgaggtcgattatgacgagcaggctgagctgaagcttggtgcagcgtatccggacaatgacgagacggaaacagagctgctgctgatcgacaacgcagaagatacggatgcaagcgaggaagcagaagagcttgaaacggtgcagtttgaggcaaaagccatcgctaaggaaattcgtaagctgatttcatcgccgtttaaggtgtatgacggaaaaaagaaaacacatcgcaatattcaataccgagatatcgtgattttgctccgttcgatgccgtgggctccgcaaatcatggaggagctgagagcacagggcataccggtttacgccaatttaacgtcaggctatttcgaagcggtcgaagtcgccgtcgcgctttctgtgctgaaggtgattgataatccgtatcaggatataccgcttgcctctgtgctgcgctcaccgattgtcggagcagatgaaaacgagctgtctttgatccggcttgaaaataaaaaagcgccgtactatgaggcgatgaaagactacctggctgctggtgaccggagcgatgagctttatcaaaagttaaatacgttttacggacatctgcaaaaatggcgcgcgttttcgaaaaaccactcagtatctgagctgatttgggaagtgtaccgcgacaccaaatatatggattatgtcggcggcatgccgggcggaaaacagcgccaggccaatttgcgtgttctttatgacagggcgcgtcaatatgaatcaacggcatttcgcggcttgttccgtttcctgcggtttatcgaacgcatgcaggagcggggcgatgatcttggtacggcgagagcgctcagcgagcaggaggatgttgtccgcttaatgacgatccacagcagcaaagggctcgaatttccagtcgtgtttgtagcaggtctcggccggaatttcaacatgatggatttgaacaaatcgtacctgctggataaggagctcggatttggcacgaagtatattcatccgcaattacgcatcagctatccgacacttccgctcattgcgatgaagaaaaaaatgcgcagggagctgctgtcagaggaattgcgtgtgctctatgttgcattaacgagagcgaaggaaaagctgtttctgattggctcatgtaaggatcatcagaaacagcttgcaaaatggcaggcatccgcgtcccaaactgattggcttctgccggaatttgaccgctatcaggcgagaacgtatctagatttcattgggccggctcttgccaggcacagagacttgggggatttggctggtgtgccagcacacgctgacatctcaggtcacccggctcgttttgccgttcaaatgatccattcctatgatttgcttgatgatgatctggaagaaagaatggaagaaaaaagcgagcgcctagaagcgatccgccgaggtgaaccagttcccggctcgtttgcgtttgatgaaaaagcccgcgagcagctgagctggacctacccgcatcaagaagtgacgcaaattcggacaaagcaatcagtttctgagatcaagagaaaaagagagtacgaggatgaatacagcggcagggcccctgtaaaaccggctgatggaagcattctgtacagacgtcccgcttttatgatgaaaaaaggcctgacagcggcagagaaagggactgccatgcatacggttatgcagcatatcccgctgtcacatgtgccgtcgatagaagaagctgagcagacggttcacaggctttatgaaaaagagcttctcactgaagaacaaaaagacgctattgatatagaagaaatcgtgcaatttttccatacagaaatcggcggacagctgatcggtgctaagtggaaggaccgggaaataccattcagcttagcgcttccggccaaggagatctatcctgatgcacacgaggcagatgagccgcttttagtgcagggtattattgactgtctctatgaaactgaggacggattatatctattggattataagtcggaccggattgagggcaaattccagcatggatttgaaggagcggccccgatcttgaagaaacgatatgaaacgcaaattcagctgtacacgaaggcagtggagcaaattgcaaaaacaaaggtaaagggatgtgcgctttatttctttgacggagggcacattctgacattatagcgagatccataagctccggaatttcaggcggagcgggtctcgttttctatataaaagagaggtgaaagcatttgcggattttacatacggctgactggcatcttggaaaaacgcttgaaggaagaagcaggctgagtgaacaggccgatgtgctggatgaactgaatacgattgtaaaggatgagcagatcgatgccattgtaatggcgggggatgcatttgacaccgtaaacccgccagctttagccgagcagctgttttatgaaagcctgtctgcgcttagcgacagaggaaagcgcccgatcgtcgtcattgccggaaatcacgataatcctgaccgtttgtccgccgcttcaccgctgacacatgaaaacggcattcatttaatcggttatccgacaacagagccgattcatattgaagtgccttcagcaggagagcttttggcggttggagcgctggcgtacccatctgaagcgcggttaaatgaagtgctatccgatacgtttgatgaaaagctgctccgtgatcactatgatgtgaaaatcaggcaggcgtttgagcatatgacaagccggttccggaccgatgcagtgaagattgccgccagccatatttatgtggcaggcggaaaccaaaccgattcagagcggccgattgaagtcggcggtgcatacacggtggctgctgaaagcctgccggcagatgccgcttacgttgcgctcggccatttgcatcgcccgcaaacgatcaagcgggcgcggacgcttgcgcgttattcaggatctccgctcgcctacagcttttctgaagcgggctacgctaaatcagtgacgattgtggacgcaaagcctggggaagaggccacttggcaagaggtgttattatcaagcggcaagccacttgtgaagtggaaagcggcaaatggattaagtgaggtgtacagctggctggatgaaggcagagatcagaatgcttggattgacttggaaatccgtgtcgcggaccagctgtcacttgaagagattcacaggctgcggaaggcgcacccgggctttatccatatcaggccggtttttgaagaacagaacaaagaccgggaacggatcgaggttaaacatgtctcaatcgaggaccgctttaagaaattttatgaaaaacaaactggcggtgcggtgccggatgaagaaatggtgaagctgtttttagagcttgcatcaggcgttgaagaggaggatgcgaaatgaagccgatcgccttaagcattaaggggctccacagctttagagaggagcagacgatagattttgaaggcctttccggtgccggtgttttcggcattttcggcccgacaggaagcggtaaatcctctatactcgacgcaatgacgcttgctttatacggaaaggtggaacgggcggcgaataatacgcacggaatcttaaatcacgccgaagatacgctgtctgtgtcctttacctttgcgcttcagacgaatcaccaaatctcatacaaagtcgagcgtgtgtttaagagaacggatgaaatgaaggtaaaaacggcactttgccgcttcatcgaaatcaaggacgagcatacggtgctggctgataaagccagcgaagtgaataaaagagtggaggagctcttagggctgacgatcgacgattttacgagagcggtggtgctgccccaagggaaatttgctgaatttctgtctttaaaaggggcagagcgcaggcatatgcttcagcgtttatttaatttggagcaatatggagacaggcttgtgaaaaagctgagacggcaggcgcaggaagccaatgcgagaaaaaatgaaatgcttgctgaacagtccggtctcggtgaggcgagctcagaggcagtggagcaggctgaaaaggttctcgaacaagctgaagcccggctggaagcgatgaggaagaaccgtgatcaggcgaaggagcggtttacagagcatcaggagatatggaatgtccaaaaggaaaaatccacttatgaagaagaggaaaaacgtctcgcagaagaacagccgcatatagacagcatgcaaaaacgcctgctggaagcagaaacagcagcagcccttaaaccctatgcggaccggtacgcagaagcgatccagcatgaggagcaagctgaaaaggaacaaacgctagcccaaaaggatttagcagaccggacagctttctttcagcaaaaacatgaagagtatgaagcgtggcgccagcataaaagcgagaaagagcctgagcttttaacagagcaggaacagctttcacgcttgcaggaaatcgaaatcaaactgagtgaggccaagcaagaggaagagcgcaaaaaggctgacctccggcagaaagaagcggctcttcaatctgtcatgaatgaattagaggccgtaacagaccgcctgacacgagggcaaaacagacagacagaattgaaacagcagctcaaatccctgcaggtgacatccgatgagcgaaaaagctgccagcaggccgcagaaatggcattgcgcatcagacaaaccgaggagcaaatcaaaaaagagaaaaaacgaagtgaagaattgaacctcgtgctgcagaagatgaatgaagagaagaatacactcgttcaaaagacggaagcggaagaaaacaacatcattcaggcatatgaggctgtacaaactgtgtaccatttggtgtgcgaaacggaacgctcattaacacatatgacggaagaggctagaaagagtcaacacacgcttcacttacagcgtgaaaaagcaagggtggcactgctgacaaaagagttagcccaaaagctgactgccggtaagccttgcccggtatgcggttcaaccgatcatgatccatctgcctcagtacatgaaacatatgaagccgacagccatcttgaagaggacattaaacggacagatgtattattgacggaagctgcagctctcagccaggagattctttcagccaaaattacgcttgaagaacagtccgcgcgctttattgaacagtgtccgtttttgcagacaattcaagcacagaaccttgaagcggcagcttccttcgaacatcagccggtgtatgaagcatttgaaactgccaaatttgaatggaaacgaatcaagcaggacattctttctgttaagacacgaatggcacaaatgattggcgcctatcaggagtctttaaaaaaggccgagcagcttaatgaaaaaatcggttttgaaaaaagagaagctgaccgtattgaaagcatcatcagcgagcttcaatcctcaatggacagcagtctgaatatgtttaaagaagcatttcagaatcaatctgtggacgaagcagaaaaatggcagcaagccattgaagaaaaggaccgggctgcagaagaatgtgaaaaacgaattgagaagagtatcgcgtttcttgctgagcatgaagcacaaaaggaaaaactgcgggaatctggacaccggcttgaacgggaaaagctggagcttcattatgcggctgaacgcatcaagagcgtgatagctgattatgagcacgaactcggagattatgcaaaaggagattcgattcaaatcaaactccgctctgtccagcaggatctaaagctgttaaaggaaaaagaacaatctttatatgaagaactgcaaagcgcccaaatgaagctcaaccaagcgaaaagccgcgcttcggcaagcgagctcactcttcaagaggcgaagggcagattggaaaaagcaaaagctgcttggcttgagcatacaaaaaacacctccattacccggactgaggaggttgaacaaagtctcatcccagctgatgaacttgaaaagatgaaaaccggcatagaccagtttatggataaactgaagcaaaatgctgcaaacttaaaacgagtagcagagatacttgccggcagagcattatcagagagcgaatggaacgaaaccgttgcagcattacaaaaagctgaggacgcatttggcgctgctatagaggaaaaaggcgcggcagcaaaagcactggctgtcattcgcgaccatcataaacggtttaatgaaattgaagctgaactgaaaaaatggcagacgcatatcgacaggctggacaagctgcaagctgtgtttaaaggcaataccttcgttgaatttttagctgaggagcagcttgaaagcgttgcgagggacgcctcagcaagactcagtatgctgacaagacagcgctatgccatcgaagtagattcagaaggcggcttcgtgatgcgggatgacgcgaatggaggcgtaagacgcccggtttccagtttgtctggaggagagaccttcctcacctcgctttcacttgctcttgcgctgtctgctcagattcagcttcgcggggaatacccgctgcagttctttttcttagatgaaggcttcggcacactggatcaagatctgcttgatacggttgtaacggccttggaaaaacttcagtcagacaatctggctgtcggtgtcatcagccatgtgcaggaactgcgtgcacggcttccgaaaaagctgatcgtccatccggctgaaccgagcggccgcggtacgcgggtatcacttgagttgatgtaagggaggagcggatatggcaaagcagactgccggaatatgtgagctgtgcggccggagcgatgtccagctgacagagcatcatctcacaccgaaagaggaaggcggaacgtttttgccgacagcgatgctctgtattccttgtcataaacagattcatgccttatataccaatcaagagctcgccgtacgtttaaacggaatggctgaactcagaagcgatccagagcttgcccggtttgtcaaatggatcagaaaacagccgcctgagaagctgatcaaaacaaagaaatcaaatgaacgaaaaaagaaaaaatgactaaaaagcagccctctctttgcagagcggctgcttttatccgtttccaaccatatcctgatcgttgacatcggggtctatataatttgtcgcgttgactgcattatttaatagaaggaaatctcccgtgtttcctgctcccgaaccgagcgcagattttgaagagcttttcggagaaaggtaaaaggaatcaccaaagtttacgactccgcccgatatggaattgatagctataggcccgacaattgctggcataaacgacaccctttatcgaagtctctgtttattatatgttcttggcgggcgattgtgagcgcggagactgaatctgtctgatatgtttgagtctcgcatcaccgcgaataagcgaagctgatccggcatgtaaaacagaagaggctgagaccccttgaattttgatgctgcgaacataaatagccggcacctcgtggcaaaacgcgctttgtacacctgtttcggggagcggcttcacagcctgctgctgaaagatctgatactcctttttgttaaatgagccttcattatggtaaaacgtggacagagaacgctgcacagcaaatacttttacactcatatcgatttcatttgtgtcgccaacttgaaacacacttgcgatcccgagggaattaaacttaactagtctgatgcgcgatatgcgtttaagcattattctggcgcaagcggagcaaacggcccaataataagagattcaggcggtgtatcaaaaatagaagacaggtaaatggattcagtgtctccgatgtggaaaacggaggaactggacacaccgttcatccggatgtccccgacttctaagctgcggttgatgactgtaaagatcatgcttgctcatctcctttcatttctgatggaatatgctccagaaagtgttctacagcgcggatgacatcacgcttcacatgctcagcgatatgttctgcatattgtgcaggcggtgtatgttcttcttttttgatatgggacatataataatggattcggctgtccatttgttttctgatgtcttcaataacatgatgtctgtttgtatcgtcaagtctgctgtcatattggttttcaagctgttccaaaatatctgggatttcctcggttaagtacatgtcgacattctggcggatctgctgcatgagctgagcgctctcttcctgctgcatcatcccgatttgcggtgtcgactggctgacgtcaaagttttggacgctgttcgggtcagtcggatttaaaccgatgttcaaagtcccgtcgagcctttcgattttcagctgatcaaatttatactccacacgctcaatggtagtggccggccgctgtttcatcgtattcatttcagtttgaatctctttcagctgacgttcgagctgctgaatgtgaatcgcctgctgctgaacgaaggaattcaagttttgcaggtaagaggaaacagattgatcatacatgttcttcacctctttcatatgattaacggccaggaggctggagcgggaccaatgaacctgtgtcgggctcctgcagctggagcggttgccctgagccagaaacttctggtgccggttctacatagcttcctgtattatacaaatttgacagtgacttgattgatccggcgctcccgatttgcagaatggaggagttgctgattgattccagccggagatagttgatttgaatggtttgattaatatagaagttcatgagcctcactccttttacgcattggccacgatcggctgatcaaccgcatcattgtcatacacattcgtcgcgttttgataattcatcaccttgaggctgtcgccggtattaaagctgccagcaccggcaaacgttctgacctgagcctgaggagaaatcgtaatgcagtccccgatgtgaacgactccgctcgtaccaatcgcattaattttaaacgctccgacaatggccggcatacgagcacatcctttgttgaaaaattaaaaaaagacaggtaaagtgaaatgacaattctgatttcaattgggctattcacgatagcttatgacaaacgcacatatgtgtgagagaaatttaaaggggacatatcggctctttatgaaagcgctttattttttcgggccgttatgtttaaacatggcaaaagaggatgttgggtataaattgagcggaaatgcggcgaaggatgccgctatccgcctatggtgatttttgtttatttctttggtgtttttgcgtgtagaatgctttttggagtatgtcgtgctgcggtattcgatttttgggcgggcacattctcgccctgaggtatatcccagaagtgctgagcaaaaagcggagttacatgtggtgtattctaattgttatagaaaatgatttacatacgggagttttcaagatatctcccaaaaatcatttcttctttaatccgggtattcagcaggatatccagctcttggctgcattgaatcgtttcttttgaattcatgccatatttttgtgcggtttcaattagtgtgatcctcatttcttcaattttactgttcattacgctatctccaattctagattttattttgatataaatacaggatatcgttagtataacctattttggctcaaaaggttgcctttcgtcaatttgactaaaaaagcgacaatttttgctgcggccttttttaatggagaaaggactaaagtcttgctaagtgtgcttgcaaaaagtcctgccgttcctcaatttctctaagtatgttggtctgctccttttcgatttgaaaggggctttttttgataaaaggatcatcagcagcactttgacaaatgtcaaggtgccattcgttgatgagaggagataatcgttcaatagtaaacgaccgcttcagcacgtttttcattaaggtgtgatattgcgacctgaaggcgggaatggatagaagccttgacgaaagcgtctttccttttgtcagaagcgggtcttcttcataccattcttgtacggcaagcgatcttgtctccatcggggaaacgtaaagccgaccggattcgtttaaacaaaatgtgtagtaaaagccttgattggtgcaggcgttgccgatcagccacaaaaaaaacagcttgacatccagatacaatttaatcctttcagccaattcgtcatctccggctgtgcggatcagtatgaaaaattcatgtaagaatgccgagaaatcattgttaaaaagggacaatggaacccttggatcggccgtcttcactccgtaactccttttaccggctggctgatggttcttgatgttcaaataaatgccttcaggctggccattgatggtcagaaagctgtacgaggcaacgggagcaggtacgccgatctggtcaaaaaaacaataggcgagtctgcgccgcatcagggacggatcatcctgttctgcattcaaaaaaagtgtcctttcaccaagcagagacttttcccagctgatttcataggatgccttttccgctctgtcacgctgtgtgagaagaatgggagaaacagatcgatctgttacgaaaagccccttggctgtacctttccttttcagctgctcccgatgaaaaaataaatgcacgcgctccatattctttcctccttctcaaaacgacatttgtatgatatgtagagcaagcccgtcctgaaacgaaatgaaaacggaaaggagaaaaagggatttcagcattcgacagagaatacatgaaggagcattctgatttaaaagatgatggaggaataacatgaaatttgcgacaggggaactttacaaccgaatgtttgtcggcctgatcattgacgatgagaaaattatggatttgcaaaaggctgaaaaaaaactgtttgaacttgagacgattccgggatcgctgattgaatgtatcgcagaaggggataaattcgttgcgcatgcaaggcagctggccgagtgggcaaagaaaccgaatgatgagctgggatcatttatgtattcattatctgaggtgaagctccatgcacccattccgaagccatcaaaaaatatcatctgcatcggcaaaaactaccgggatcacgcgattgaaatggggagcgaggctgatattccggagcatccgatggtatttacaaaatcgccggtaacggttacggggcatggtgatatcgtaaagagccatgaagaggttacctcccagcttgattatgagggagaacttgctgtcgtgatcggaaaaagcgggacccgcatttcaaaagaagatgcatatgaccatgttttcggatatacgattgtgaatgatatcacggcgcgtgatctgcaaaaaaggcataagcagttttttatcggaaaaagcttggatacgacatgtccgatggggcccgtgcttgtacataaatcatctattcaggagccagagcgcctcaaggttgaaacaagagtcaacggcgagctgcgtcaatccggttcggcaagcgatatgatcttttccattccggaattaattgaaaccctctcaaaggggatgacgcttgaagcgggcgacattattgccaccggtacgccatctggtgtcggcaaggggtttactcctccaaaattcttgcggtcaggtgacaaaattgatattacaattgatccgatcggaacgctgtcaaaccaaattggctgaataaaactggagggcggacccggacccgcccgttttttctgataatcatctttgtggcagaggacaagttcatggtactataagtggggtaatttatctgatagggggaacatatatgacacacctacatattacgacatgggtggtagcgctgattctgcttttcgtcagctactcgctgtattcgtcaggaagtgcaaagggcgcaaaaatcactcatatgattctgcggttattctatatccttattattttgacaggagctgagctgtttgtccgtttcgccaactggaacggagaatacgccggcaaaatgattctgggcattatcaccatcggcctgatggaaatgctgctcatccgcaagaaaaaagaaaaatcaacaggaggcctgtgggtcggcttcgtcattgtccttttgctgacagtgctgctcggtctgcatttgccaattggttttcaattgttttaatagaaaaacctatgaacccggctctttgatagagttgggtttttttatatttatcccctcatattccaaatcatttaaaataaccttaaaattccctgtaagcggtatctcgtcctatgaaattatgataccttcaaggagattcattattttgcaggagggataacatgaaacgcagaaaattcagctcggttgtggcggcagtgcttatttttgcactgattttcagccttttttctccgggaaccaaagctgcagcggccggcgcgatcgatcaggcggctgctctggaaaacggcaaagagcagacaggcgccatgaaggagccggaacaggtgaaatggtacaaagtgaccccgggagcaacggatattcagaaaaactcacatatggcactgaccgtaaagagtgattcagtactgaatgtatctgtatatccaagtaaggaaaaagcgcttaaagatgagacgtttgagatgtaccgttctttcacagcggaggatggaaaaagcgaagtcatttttccatacgcgtggagcggcccttactatgtaaaagttgaatacctcggagaagaagagccagaggacggcggaacggcagaagcagctgcagaagccaagtatacgattgggtataaaggcaccaaaaaacagccgtcagatttagaagaggaagaagcttgtccggttgaaatgagtgtcgatcagaagaaatcaggaaaaggcatcctggataagctgagagcgattcgtgatgagcagctgagccaaacagcagaaggcaaagaactgacaagcctttattacaaagcagcaccgtttatcgttgcaaagctcgcactcaataaaacagcaagaaatgaaatctatcaggatcttgtgacattaaagccgttatttgacgatgtgtcagaaaacggagcatcatcttcgcataaggtcactgaaaaggatcaaaaagcaatcaaccggctatatgataaagctttacaatcagtcccgtcattccttaaagaggagataaagaaacaagcggaccgactaaatatgaagcagctgcaaggcaaaacagccggagccattttaacagaaaaccatattgcagcaaaaagtgaagttcagacaacaaaggttattttcaaggtgaaggacaataaaagcctctcatccgtacataatgaaatgaagggcttttctgcaagcgcgcaatcgaaaaaagacatatccaatgtgaaaaaggcaaagaaactgtttgacaatctgtattcatttgaacttccgaaagatgagaaacagaacggcgcatatacggcaagcgccaaaagggtcaaaagcgctgctgcgacactatccaagatgtccaatgtagagtttgcggaacccgtgcaggaatacaaaagcctggcaaacgacattcagtacccttatcaatggccgcttaaaaacaacggtgaaaacgggggtgtcaaaaatgcggatgtgaaatatgagcctgccaacacattgctgtccaaacgcaagcttaacgatacactcattgcagtagtagacacaggcgtagacagcacgcttgctgatttaaaaggaaaagtaagaacagatctcggacacaattttgtcggacggaataacaatgcaatggatgatcaggggcatgggacgcatgtcgcaggcattattgcggcccaaagcgataacggctattcaatgactggattgaatgccaaagcaaaaatcatcccggtaaaagtgcttgattccgcaggttccggagatactgaacaaattgctctcggcatcaaatatgctgctgacaaaggagcaaaggtgattaatttaagtttaggcggaggctacagccgcgtgcttgaatttgctttgaagtacgcagctgacaaaaatgtcttgattgccgcagccagcgggaatgatggagaaaatgccttatcttatccagcatcttctaaatatgtgatgtcagtcggcgcaacgaaccgcatggatatgaccgctgatttctctaactatggaaaaggtctggacatctctgctccagggtctgatatcccgagcttagtaccgaacggaaatgtcacgtacatgagcggaacgtctatggcgacgccgtatgctgccgctgctgcaggattgctgtttgctcaaaatcctaagctgaaaagaacagaagttgaggatatgttgaaaaagacggcagatgacatttcctttgaaagtgtcgatggcggagaagaagagttgtatgacgattatggcgatccgattgaaattccgaagacacctggtgtagactggcattcaggctacgggcggctgaatgtcatgaaggctgtcagcgcagctgatttacagcttaaggtcaacaagctggaaagcactcaaacagctgtcagaggaaacgcgaaggaaggcacacttatcgaggtgatgaacggcaaaaagaaactcggcagcgccaaagccggaaaagacaatgcgttcaaggtcaatatcgcgactcaaaaacaggatcaagtactgtatgtgaaagcaacaaaaggcgatgcgaaaacatcgtataaagttgtcgtcgtcaaaggaaaaccttccggcacaccgaaagtaaacgcggtgaaaacgaaggatacggcagtaaaagggaaggcaaacagcaaagcgatgatcagagtgaaaaacaaatcaaagaaagtcattgcttctgccaaagctgacgcaaaaggaacgttttcggtgaaaatcaaaaaacaaaaagccggaacggtgctgtacgtcacggctgcggatacagataaaaaagaaagcaaggaagcaaaagtggttgttgaaaagtaaccaaaaagcggtgctcgatgcaccgcttttttatttgcgcccccgttggactgctgaatacataatggatcgctttccgtttgaagccgtccattcaaaacggtctcctgtcccttcgctgctgtagtgatgctgcatcgcgcattgtgcggtgtcatttgaaaagtgataaaaggacacaccctgccccgccgaagtatccgaaaagactcctttattataagaaaagacgcaatcgaataccgataagccgaagctgtgcaagtgctgcagaaatgcgagaaaggtttcgtcgtcaagcgaatccaaaagcgccatgagaggccgcttgactgatttctcatagcggatgcgttctccgccggaaagggagatgttttctgcaccgcatgccaaaaccaacttgtcctgaaagccggcttgctcccactttcctttatgatggacccagattgggctgtgttggagactgtccgccagcagtatatcgccttcaccgttttcgattaagcagatgccgtcttcaatgaggatggtgccgtattcccactttcgttcctctgtatataacaattgtttccgtttcatccatgctgtctcctttttcttcattcctctcttttctttccaattcaagcctgtcccatacaactcttttatggacaaatcaactatctgcctatagatgcataaacttactaaggtgctgaaagaaacgaaattgttacgaaagaaacgggattggagctgatgtcacatgtgtggaattacgggttgggtcgattttaaaaagcagctcgtccaggaaaaacaaacgatggacagaatgacagacactctttccaaacgagggcctgatgattcaaacgtttggggggagcaccatgttttattcggacataaaagacttgcggttgttgatattgaaggcggacgccagccgatggcgtgtacctataaaggggatacgtacaccattatttacaatggcgagctttataacacggaagatttgcgcaaagaattgcgggcgcggggccatcaattcgagcgtacgtcagataccgaggtgcttctgcacagctacatcgagtggcaggaagactgtgtcgaccatctcaatggcatattcgctttcgctgtgtgggatgaaaagcgtaatctgctgtttgccgcgagagaccgtctcggcgtaaagccgtttttttacacgaaggaaggctcttcatttctcttcggttcggaaatcaaagcaatcctcgcgcaccctgatataaaagcgagagtggacagaacgggactttctgaaattttcggtcttggaccgtccagaaccccgggcactggcatatttaaaggcataaaagaaatccgcccggctcacgcgctgacattttccaaagacggacttaatatttggcgttattggaatgttgaaagcgaaaaacatacggacagttttgatgacacggttgccaatgtcagatcgttatttcaggacgcggtgacgcggcagcttgtgtcggatgtgccggtttgcacattcctatcaggcggtctggactcaagcgcaattacagcgattgcggcgggccattttgaaaaggaaggaaaagcaccgcttcatacttattcgattgattacgaagagaacgataaattttttcaagcaagcgcttttcagccgaatgatgacggaccatggattgaaaaaatgacagaggctttcggcacaacgcaccacaaatgcgtcatcagccaaaaagatctcgttgatcatttggaggaagctgtactggtcaaagacttgccgggaatggcggatgtcgactcatccctgctgtggttttgccgggaaatcaaaaaggactttgtcgtcagcctatcgggagagtgcgcggatgagattttcggcgggtacccgtggttccatacggcagatgttgagtctggctttccatggatgagatcaacggaggagcggatcaagctgctttctgactcatggcagaaaaaattgaatctgaaagaatacgtaaatgccaaatatgaagaaaccttggcagaaacgccattattagacggagaaacgggtgtggataaagcaagaagacagctgttctatttaaatatgctttggtttatgacgaaccttttggatcggaaggatcgcatgagcatgggggcgagcctggaagtgcgggtgccgttcgccgatcaccggcttgtggaatatgtttggaatattccgtgggaaatgaaaatgcatgataatcgggaaaaaggcattttacgcaaagcgcttgaaggtattttgcctgatgacattctgtatcgcaaaaaaagcccgtatccgaaaacacatcatccggaatatacaaaaggcgtcagcgaatggctgaaaacgatcagaagccaaaaggactccgtgctccataccttgctggacagaaaacaattagatcagcttttagaaacggaaggctcctctttcaaggtgccgtggttcgggcagctcatgaaggggcctcagctgatcgcccatcttgctcaaattcatacatggtttgaagcgtatcgcattgatattgacgagaggtaggttcaatgcaaatgtgattaaaagccagagatgtatagatttaaataagaaggatagatgagcagggaaatatatgctctatctatccttttttgtacaacagcactatcgaattgcccccgcattccttcaataagaatgaataggttttaatgttctgccgataaaactagctgataccgggcttaactttaattccctagcccatacagaaagttgaccaatatggtgaatttcgtgagcgatgatatggtgtaatatttcatctcgcgtatataaaacacttgtctcccaaggaacgcttacaagttcatcttttatttgatctgaatgtgtttgtaaaacatcaattatttcagttcggaatgtatttgagagagatttcactttattgagtgtttgataatcagcgaactgaacagcgatatcttcttttccttggatagcacgaatccaactatattccacatcaataatatgaaaaagggtatataaaatattctctactccgccaagacggtttttaagtaattcttcagtggttagttgatgacaccaagtaaaccattgatctctaacctgccagttatattcaaaaaattttatcactgaactcactccaatactatcatgtatcataacaattagcccttttttccgtgattcctctattattgaagtgatgattgagaaatgtttacattctacctgttgtatggcattaaaaataataatgcatatctcgtcgatgatgctgtgcgtcttgttacttttacaaagtaagaatcggcattttcttcatatacaattaggaaaaaacatactagacttgaagaagcagtgatacataggagtgagaaaatgaaagagataaaagaagcttaccagcaatgcggacagattgttggcgaatacgcgccagcctgtttcaaagcattatcatatctcccgctaaagcaaagacaagcctcttgggcagtattgtcgttttgccacacggcggccagtgcagacgaaaaggtattgcccgcatttgaagctaaagctgatcatgtttaccaaaggacaaataacggtaaacaacatctatggaaggcttttgatcatgcgtatcggacctttacattggaaagcgaaccttttcgggagtttattgccgcacaaaaagaagacgccaagccgtatgatgaccttgatgaactgctcatgtacgcatatcggacgggcggtgctgccggattgatgctgctgccgatactgacacgccgaaaacaagatcagctcaaacaagcagccgtctctctcggcttggccatacagctggttcgcttcttaagtgatcttggcacagatcagcaaaaaaaccgcattccccgtcaggtaatgcagcaattcggctatacagaggctgatctccaaaaaggcaccgtaaataaagcgttcacaatgacgtgggagtatatcgcttttgaagcagaagcctaccttgaagagtgtcaggatgccttgccgctatttccgcagtattctcaaaaaacggtgaaagccgctcttcatttgcaccgggctgttttagaaaaaatccgggcgaagcagcacgatgtatttcaatatcacttcgctctcacagagaccgaagtgaagcagattctgtctgatatctaaaaaacacccggccttgattgagccgggtgttacgccatacctttttgaatccagatacgtgagcgccatcttctgtacattaagattccccggacccattcatccgcgataaaagaaatccaaatgccggcaagaccgaaaccgaggtggatgccgaaaagataagcaagcgggaggccgatgccccacattgaaatcattgccatgtaaaccgggaatttcgcatcccccgcagcccgcagagagttaatgataatgacattaaacgagcggcctggttcaagaataatggtcatggcaatcaataggcttgcagttgctataatgtcagggctttgtgtgaagagtccgatcaggtcttttgaaaagatcgtcatcaaaacagaggtagccgcagcaattccgagtgcccaatataagctcttcatgcagcgctcataagcggcatcaaattgtttgccgccgatataacggccgattaagatttgtgtaccctggctgatcgcagtgccgaacagcaaaataaacatcgtaatattttgcgtatacacttttgttgtcaacgcctgcgcgcccatgatggcgataaaatacgtgacaatcatttgcgaaaggttgtatgaaagctgctctcccgcagaaggaatgccgattttcagcagcttgcgcaaatgctctttatgcatatgaaagacttttttcagcgacatcttcagctggatgcgtttgttgacaatcacaatcatcgcgattaatccgatgacgcgggcgatagatgtggacatggccacaccggtaacgccgagaacaggaaagccgaacaaaccgaaaatcacaacaaagtttccggcaatgtttaaaatgttcatgccgatagtgacaaacattgtatcttttgtgtagccgtagctttttaagatcgcgctgaatgtcatgattaaagcctgaataaaggacagacctccgacaacttgtaaaaagactttcgcatcaggcatcagtgcgtctgataatcccatcatatgaagcagagggacagccgcgaaaaagacgacggcgctgatggccaggctgatgaagaagttggcgccgattgacacataagcgacttccatggcttctttcttttgccgtgagcctagaaattgtgaaatgataacggtcgttcctgttgcgataaagctgaacatcacgataattaaatttaaaatctggttgctgacgccgactgctgccacgctgttatccgagtattggctgagcatcagtgtatcggcattacccataaacatatataatgagacctcaataaagatcggccaagtaagcgaaaataatgagaacgttttgtcagcgggttttttcaaagcagttgatttgaagacagcttgtttcatagtgtctaacccctttcgtaaataaaatcaacgttttaaagtgtacctccatttccttataataaaaagggatagaaacgatacttcttgtaaaaatccgacttaaaaaggaggatgattcaaatgccccgcatcctgtttacagtcccgccttttccggtatttattgcagctggggaaggggtttttaaaaaaggagaaacccatgtgaaacgtgtattctccgtgtttgatctgatatatgtcaaacagggaacgttatatataacggaaaatgaaacatcgttttctgttgaaggcggcgagtacatcttgctttctcccggtcttgaacactacgggacgaagggcagtgatgaagcaacctcctactattggcttcacttcgatgaacatcgatatgaatttacggcaaagggaggcagcaactggtctgagcttcagcaggaaaaagggagcttcgaagagccggcccgctacggattggctttgccgagaaaaggcaaggtgcagcgcccgcagtttatggcgcagcagtttgaaaagctgatcgattactccgcggaaaactctgatttgcccctcagaaagcaaatcttatttgaggagctgatgctgcatcttcaaaaagaagcgttccaaataccgtctgcgaaagagcgggtagcctgggaggcggcccggtacttacaggagcactataaggaaaagacgacaatcaaggatctgtcgctcgcccttcactatcatcaggattatgtgagccgctgcatgcagcaggtgctcggcgtaactccggcacaatacacgaaccgggtgagaatgacggaagcgaagcgtcttttatcctctacaaatgataaaatgggcgttattgcggaaacggtcggaatggaagatccgacatacttttcaaaactctttaagcagatagaaggcatttcaccaattgaataccggaaaattgtcagccggaaagttcaataaccagacgagggatgaacatgaaaacaacaatttacgatgtggcaaaggcggcgggtgtctcgatcacaactgtgtcccgtgtgataaacaatacggggagaatcagcgataaaacacggcagaaggtcatgaatgtcatgaatgaaatggcatacacgcccaatgttcacgccgcggcgttaacgggaaaacgaacgaatatgattgctctcgtggcgcctgatatttcaaatccgttttacggcgaactggccaaaagcattgaggaaagagcggatgagctcggttttcaaatgttgatttgcagcaccgattacgatccgaaaaaagaaacaaagtatttttctgtgctgaaacagaaaaaggtggatggcattatttttgcaacagggattgaaagccatgacagtatgtctgctttggaggaaatcgccagtgaacaaattccgattgccatgatttctcaggataagccgcttcttccgatggatattgttgtgatagatgacgttcgtggcggatatgaggctgccaagcatcttctgtcactcggccacacgaacatcgcctgcattattggagacgggtcaacgacaggcgaaaaaaatagaatcaaaggcttccgtcaggcgatggaggaagcgggcgtgcccattgatgaatcacttatcatccagacgcggttttccttggaaagcggcaaggaagaagcgggaaaattgctcgacagaaacgctccgactgctatttttgccttcaacgacgtattggcttgtgccgccatacaagctgcgagaataagaggcataaaagtgccggatgatctttctatcattggttttgataatacgatactcgcagaaatggcggctccgcccctgacaaccgtagcccagccgataaaagagatggggcggagcgtcatcgaactgctggcagaagcaatagagggaaaacgaaaggcgaaacaaaaaatagtgctcccgcctgagcttgtagtcagacattctacatcaccgctcaacacatgagcccgctaatgagcgggttttttcattatgacagttgaagccaaaaaaacatattgcgtgtaaaccaaaggcagtgtaaaatgaaaccatcttttgagaaagcgcttgcgcaaaatggcagagcggatagaaccgctgtttttttagctgttaagagaaagcgctttcccaaagcgagcccgaaatgagataaaggagaggatgggacgtggaacatcaagtaaggtgcgcagtattgggattaggaaggctcggttattatcatgcgaaaaatctcgtcaccagtgtgccgggggcaaagctggtttgtgtcggtgatccgttaaaagggagagcggagcaggttgccagagaactcggtatcgaaaaatggtcagaggacccgtatgaagtgttagaagataccggcattgacgctgtcattatcgtaacgccgacaagcacacatggtgatatgatcatcaaagctgccgagaacggcaaacagatctttgttgaaaaaccgctgacattaagccttgaggaatctagagcagtttctgaaaaagtgcaggagacaggtgtcatctgccaagtcggctttatgagacggttcgatccagcatacgcagatgccaaacggcggatcgacgctggagaaatcggcaaacctatctattataaaggctttacgcgcgaccaaggcgcgcctcccgcagaatttatcaaacacagcggtgggatttttatcgactgttccatccatgactatgatattgcccgttatttgctaggggcggaaattacttctgtttcaggacacggcaggattctgaacaatccgtttatggagcagtacggcgatgtggatcaggcgctgacgtatattgaatttgactccggcgcagcgggggacgtcgaggcaagcagaacctctccatatggacatgacattcgggcggaggtgatcgggacagagggcagtattttcatagggacattgagacatcaacatgtgaccatcctatcggctaaagggagcagttttgatatcattccagactttcaaactcgttttcatgaagcctactgcttggagcttcagcatttcgccgagtgtgtccggaatggaaaaacaccgattgtgacagatattgatgcgacgatcaatttagaagtgggtatcgccgcaaccaattcctttcgaatcggcaggccggtacagctagatgtgaagcacgcttatacaggtatgtaaaagctaaatatgttgcattttaggctttccgcaaaaaaaagcaaggacatttttagcccttgctttctcttttctcatataaatagtacatataatcagtaggtatgcctgaatggcccagctgtctcagcatggcggttacgttacctctatggtaagtcccgtgattgacgacatgcaggatggtgtctgcataggttgattccagtgtacctagtttcggatgctgcattgtgaaggtctgttctaagtccgtctggcggctgaagaaatcatgatactgtgactccagctcggcagcgtgctgtttaatcgctgccatattaccttgcgcggactctaatttgcctgcgctgtctataatctcttggtaggccactcccgaaagaacattcagccaaatgtagtcagccctgcacatatgaagcagcacgtcgctgacagaaggaaatacgctctttacttcttgataggcagtttcctccggcaggttttcgatatgggtaaatattttcttgtttgcccaagaatgatagtcataaaactgttttgcatcagtcatcagcatgcccccttttctaagaaattcgtttttttcatctgtttctccttcaattgcaaaagagtgacaccccaaaatatcctgccgctgcccacataaccgctgcagagcatttgtttacgatcagcataagcctgccgctcgtatctatcgtctgaaacaaccggcccgctattgcaaggctgataaaccaaatccaagacacagcgatgcaggcggccataaagagccatttctcaagccccgaatattgaagagagctcgtgccgatgacgccgatcgtgtccagaatggcatgcgggtttaaaagagaaacagcggccgcaaacgcagcttgcttttttggtgtgaacgtatgtttctcattttggcttgtgttcggacggctgttccaagtcacccagcccatataaagcaaaaataaaaatccgccggccatcatgactgtctcaaacacaggcagctcctgcacaatgacagacacgcccgcaacggctaatacgattaacagggtatcgcagactgaagcactgatgacagctgggagagcccgccaaatatgcttttgccacgcgccttgctgaaaaataaacacattctgcactcccagcggcaaaattaagccaaacgcgagcacaattccgtgaatgattgcattcatgctgaaaaagctcccttcacatttttttcaatcataagagagattgtcactaaagtctccagccatttggttgggttagaaaccagccaaatgtataatgtgtaaaaaaggggggcatgaccttgtcgcaatggcagccaagccgaaagtcggatgttccgctgcatcggcagatcgaacaatatatgaaagacaagattcttcacggagagtgggctgtagggacgaaaatcccctcacagagaacgctggccggcatgtttcaagtcaaccgcagcacagtcacagcagccatagatgaactcacgtctcaaggcttgttagagggaagaagaggcggcggtacgaaggttgtaaacagtacttggagcgtgctggcggctgagcctccgcttgattggagcgattacgtccgttcgggcattcatcgcgccaattcttccatcattcaagctattaatcagaacgaaccaagagcggatatcatcagattaggaactggagaactttcaccggatcttgtgcctgctgacacaattggacggatgtttcagcaaatcaatccgggcgccctgtctttaggatatgagcagccgaaaggaaaccgtcagctgcgggaggcagtagccgaccatttaaaaggaaagaagatccatgtgtcaccgtctgcaattttaattgtgtccggtgcacttcaggcacttcagctcatctcaattggacttttaaaacgagattctgtcattttgacggagaagccgtcctaccttcaatccttgcatgtatttcaatcagctgggatgcggcttcgcggcttgccgatggatgatgaaggggtcaaagcggggcttgtttcttctaatcgaaaacaatatggaggacagctgctttacacgattccgtcgtttcataatccgacaggcacagtcatgtcagagcagcgaaggaaagagatcatcagcctgtcaaaaaaagagcagctgcccatcattgaggatgatgcgtacggtgatttatggtttgaagaaaaaccgccgcagccgttgaaagcaatggatcatgagggcaatattctgtatctgggcacgttttcaaaaacggttagccccggtctgcgaatcggctggcttgccggtccggagccggttattgaaaggctggcggacattaaaatgcagacagactacggatcaagcggcctgtcccagtgggcggctgccgagtggctgtcacaggggtattatgaagagcatctgacttgggtacgcaggaagcttaaagaaaggagagacgcagccgttcattttctcgagcggtatgccggggacattgccacgtggcggattcccgcaggcggcttttatatttgggtgacatttcacaaaaacctgcctgtcagccgtttcttttatggattgctgaaacggcaggtgcttgtgaatcccggctacatttatgacggtgaagaccgaaacagcatcaggctgtcatattcctatgcatctcttggagatttggaaactggcattaaagcggcagctgaaacagcacgctgcctgatgatgtcctaagctttggttatacgatgacagctcccagtgccctggcgaaggcaatcgcgtgctcaggtgcgattttgcagcctttcaatttgtcgagggagacatgaagctgttcaaaacggcacgtgctgatgtccatgttttgaagggatgtgccggtaaagctggcgccttccaattcgcatccgtcaaagtgtgtctgctggagcaccgtattgctgcattcactttgcataagagcacagtgatcaaatcgaacttgtttcatatttgagtacgaaaatgagctgaaatgtccgtggcattcctcgaatgaaacatttcgcagcgttgcttccgccacattcattccaaccatttttgactgcttaacagaagttctgtgaatgacagccccgctgaaatcggcgtttgataaatcacatttttcaaagatcacatcggtcagttcaatatgccgaaaagacacatcgataaagacgacatttctgaataccgttttttcaacacagagtctttcgatatcttcgccgcagattgtacaatcttcaaacaaatgcatgctgattacatcatcctgcgtcacggcatcatgaaaatctgcggtttgcaggttttccggtatgttcggtttttgaattgcgattttattcatgtgatgacatcctttgctgcccgaaaaacagaggcttccgggttcaatttaatagatcgttaaggaaattgatacatatagtaaatcgtgaagagccttttcttggtacagcagccagcttgttttgtaagcataaatggaaagcttcctatacgtcaaggcgtttacaggccgggaaagccaaagggaacaggaggaatgcggaatggggcattacatcaaaaccgaggagcatgtgacactgtttgtagaggatatcggacatggaaggccgatcatctttttgcacgggtggccgttgaatcataagatgtttgaatatcaaatgaatgagcttccgaaaaggggatttcgttttatcggcgttgatttacggggatatgggcaatctgaccgcccttgggaaggctacgattatgacacgatggccgatgatgtgaaagcagtcatttatacgctgcagcttgagaatgcgattcttgccggtttttcaatgggcggcgccattgcaatccgttatatggcaaggcatgaaggagccgatgttgataagctgattttactgtctgcggcggcccccgcgtttacaaaacgcccgggttatccgtacgggatgaggaagcaggatattgacgatatgattgaattgttcaaagctgatcggcccaaaacactggctgatttagggaaacagttttttgagaaaaaagtgtctccagagcttagacagtggtttctcaatctgatgctggaggcctcctcctacgggacgatccactcgggcatcgcattaagagacgaagatctcagaaaggaacttgctgcaatcaaggtgccgacgctgatcctgcacgggagaaaggatagaattgcgccgtttgattttgcgaaagaattgaagcgcggcatcaaacagtcggaattggttccgtttgcaaacagcgggcacggagcattttatgaggaaaaagagaagatcaacagtttgattgcgcagttctccaactcataagaaaaaacccgacattgatcgggttttttatataattcctctgttttgcagtgcgttaatgatgagatcagctccatcggaaatagaggtctggtctgactcaatgatgaaatcgggtgaaagcggcgcttcatacggagaatcgatcccggtgaaatgtttgatctctccgtttcgcgcttttttataaagcccttttggatcgcgctgttcacaaacatgcagcgggcacttcacataaatttcgaagaactcacctttaggaaagagcgctctaaccatgtcccgatcctctctgaatggagaaataaaagccgttaaaatcatttgcccgctgtcgacaaacagcttcgccacttctccgatccggcggatgttttcaatcctgtcaccagtctgaaatccaagatctttgtttaagccgtggcggatattatcaccgtcaagcacgtagctctgaatgcccttgcggtaaagcttttcatcgacagcattggccagcaccgattttccggagccggacaaacctgtaaaccaaaggacgcagcttttgtgtccgtttaaggactgtctgtcagactttgagatggcagcgggatgccaaatgatgttcggattgtgtgtcattgcaattccccgctgttttgcttgatggcaacaggctgttggtgaagtcccttgatcagcacggctgcgacctcaggccggctgaattctttaggcggctttttgccttggcggagaagctctctcacttttgtgcctgataagtggatgtggtctctcgggctgtgcggacatgttttggaggtgcccatgtttccgcattttcggcaataaaagctgtgctcaaaaaacagcggcttgatgcccagctcttcctctgtgaatgattgaaaaatattttgggcgtcgtatgttccatagtagctgccgacacccgcgtgatcacggcctacaataaaatgggtgcagccgtaattttttcggacgagcgcatggaaaatcgcttcccgcggacctgcataacgcatggcggcagggaaaaccgataacatgacacgatcctttggataatagtgattaagcaaagcctggtagctctccattctgatatcgctggggatatcgtctgactttgtttctccgacaagcgggtgaagcagcagaccgtcgaccgtttctaacgctgttttttgaatgtattcatgcgctctgtgaacagggttcctggtttgaaagccgacaatcgtcttccagccgagttttttaaaggcggctcttgtttcagcgggcgttgcataaaactgttcgaaagatttgtcaggcaggcggctgaccgtgataggccctccgatatagtaatccgggcgcgccagcaatttttttacgcctgggtgggcaggatcgtttgttttaaaaacagacagtgcttcttgtgttttatcaggctggtatatatcggtgactgtgatcatgccgtaggtaacaccgtctttcacaagcttgacgtgatctccggcagacagctgttttgctgttttttctccgacaggcagcgtaatcggcaggctccacggcaagccgtttgccagcctcatttctttcacaacacgatgataatctttttccccaaaaaaacctgttaacgggctgtatccgccgatcgcgataagctccagatcactcagtgcaagctgatccagctctgcttggcacgcgcacccttcaaaatggcatgcgggatcacagcggttgattaatacccctccatggggttcgtttccattcaacgtgttcaacctccatttatacgtttccttgttttcttttctgcagttaatgaaagtttgacatcagcgtctcaacatcatttcgattctcacatcaagaacctgccatccgctattcctgatgcaggccgcattctgttttctcccgtccggcccatcttccagccctctcatcgttcgggtccggggaaggcagtgtacacatttcacagcctatgctcggataatgttgatcgtgcagtttgttataaggcaaattgtgcaggcggatgtacgtccaaacgtcatcccatgtccagtggataagcgggcaaattttgatgagctcaaacttctggtccaggtttacgtattgaatatgctttctcgttggtgactgatcccggcgcagtcctgaaatccaagctgtcatgccggacaggtgctttttgagcggttcgattttccgcaattggcagcagaggttcgggttatgcttccacagctctccgccgtacttcgtcccctgttctgttaagctcagctcgggttcgagcatctggattgcaaatcccggatatcgctctttgacggtctcgatcagctcatatgtttcctgaaaatgaagcccggtatccaaaaagatgatgtgtgcatttttgttgatttttgatattaagtcgagaagcaccattccttctgcgccaaagctgcaggcatacacaatcttttctccgtacgttcggtaagcccatttcaacacatcgagctcatcgatcaattgatccgttatccgtttggacagcatgtcgttccatgtgtcatatgtgatggtttcgttcaatgttttccccccgtttgcatctgctttttttatctattgatcgagttataggcagactattcattttttgcataaaggttcaggttttaggtgccgcgcccgcctaaaatgaggtgcggaaccattaagagcccggctgaatatgctttttagcaaaatggttttatgcccaaggagaggtagtatgccgattgccatttatcaggggcatcatcattcgcttgccccggcggacattaacatcgtcattgatgtcatcagagcctttacggtcgcccattatgcgtttatcggcggggcgaaagagattttgttggtccggacagctgatgaagcctttgcgctgaaagacacctatccggattatgttttgacgggagaggaaaagggggtcggtatcagcggatttgatttagataattctccaaaacgtatggctgggcagaatatgacggataaaagcctgatccagaaaacaacaaacggcgtcacagcagcattgggggcgctgaacgcaaagcatctgttcgtaactggattttccaatgccaaaacaacggcacagcatgtgaaaaagctcgtcgcaaacgattgtgtcataaacatagtggcttcccatccatccggtgatgacgatatggcatgtgcggagtatatcaaaggcatcattgaagggacaaatgtggtaacggctgcggaggcgattgaaagaataaaaggctcttctgttgcggagaagttttttgactgccgccagccattgtttgattcggaagacatcgtttactgtacaaaagaactgacgggcgatttcgtgatgaaagtgaaacaagatggagaagttccaacgatagagagggtcataatatgaatgatttttcactagaattgccagtgagaacaaacaagccgagagaaaccgggcagtccattttaattgataacggctatcccttgcaatttttcaaagatgcgatagccggagcgtccgactatattgattttgtgaaattcggctggggcacctcattacttacgaaagatcttgaagaaaaaatcagcacactgaaagaacatgacattacatttttctttggcggcacactgtttgaaaagtacgtaagccagaaaaaagtgaatgaatttcatcggtactgcacctatttcggctgtgaatatattgagatttcaaacggtacgctcccgatgacaaataaagagaaagcggcttacattgccgatttttctgatgaatttcttgtgctcagtgaggtgggcagcaaggatgcggaattagcaagccggcaaagctctgaggaatggcttgaatatatcgttgaggatatggaagcgggcgcggaaaaagtgattacagaagccagagaaagcggaacgggagggatctgttccagcagcggcgatgtcaggtttcaaattgttgacgacatcatttcctcggatattgatatcaacaggctgatttttgaagcgcctaacaaaacgcttcagcaagggtttattcaaaaaatcgggccgaatgtgaatctggccaatattccatttcatgatgccatcgcgttggaaacgctgcgtttagggctaagatccgataccttttttctgtaaaatagcggctgcggggctctcgtcgtgaagagagcctctgcctattattttttatggcggtacataggcgtgagatagggaagtgaggtcaggcggatgttgtagatgaagtcgatgactcttgtcgatatcacctggcatatgagggcttgaatgacgatgccccagtcaataatagacgcggtgaccataaaaatgatgcaattcatgatgagcaggatcgttccaggattcccgccgcggtagatagaaatcatcagagcaagggctccgaatcctccgttcgaaattttatatttgtataaaagtccgattccgagtcccaataacactgcgccgcttgccagatcaagccacaggttagatgtgatatcaggaaaaactgcatcaaagatcaataccgagacagaggtgacggtgatagaagcgagggtgccggtgaatgttctcatctccagccattttaaagcggtaaaaagcattgatacattcacagcccacactgaaaatccgtgggggatttgaaacagataatgcaatagcaccgcaatacctgctgcaccgcctgtcggaatatcatgcggaaataaaaacaaggacatgccgagtccctgtagtacgccgcctacgacaatcataaacgtaagttttgctttcatcagcagttcagccattaagtcatttgctcctttatgaaaagacttgtccgctgttttcattttatgaggctgtccattatttatgtctcaaaataaagaaatggcccagcttaataggctgagccatcccacttgtagcgattgacgatctccatattgatctctgtgccaatgccttttcctttcgggatgtggaccattccttttgaaggctgcaggctgacgagatctgtaaaaggattctccatgacgtcccactcgatcggttcaatgtgatcgtacttcattttagaccatgggggcagacaggcttgtgcaaataaagcatagagccgtgaaagcgatccgtcatatgcatgggcggatgctctgacgccgaaataacgcgtgagctggaggcagtcccgaaactcatcaattccgttgacatgcatgacatcgggctgaatgatatccaaacagcgctgtgaaaggagaggcacatattgcgccgggcctttcatgttttctccgccggcaacaggaacagacaaacggcttcgaagcatagcgtaatcctgcggctgatcaaagggcaaaggctcctcaagccagccaatgttcgtccattcggagaaatagcgctcccatttaaaagccgcagcggtatcgtagctttggtttgcgtccagaatcatcgtaatggagctgcctgctgtatgctgcagcgcattgatgtgccggacatcctctttgaatgaagtcccgccaattttgactttgatttgctcaaaaccttttttcaactgggcttcaacattggagactgagcggctgatccattgcggggagtctgagtacgattgaaaagacgcgtacacaggaatctcctctctgtatcgcccgccccataattcgcaaaccgaacaatccgcagctttggctgcaatctctgtcagcgccatgcttacagcggaggccgcccgctggtgccatttttgaatcgtgcgcactaatgacaggcggctgccagcctgttttcctaaaagaaacgggatgatccgtttcgtaaaaccgacatggagagcagggagccaatcaacacattctccccagccgtctatcccgctttcggtgataatcctgatcagataacaagtccgatatcgtttaagcccgttggcgtctccgtatggcttgtttaatcggtgcaagagcggaaaggtttcaatgcgtacaatcttcaaaccgtgtgctacctttcctcagcgggctgcagccgattgccagccattttagggtcttctttctcttttgtttcttcattattttgcttcacatggattaacatcatcacaagaatgccgacaacgagagtcaatcccgcaatgcttaaaaacatgccgggtctggaccattgcatcaggcggccgaaaatcggagggccgattgctacccctaagaagcgtacagatccgtacagcgaggtgacaaatccccgtctttccttgccgacagccccggtaatgaaactgttcacacaaggaaggacaagacctgagccgatactgctcagcacgagaacactgataaagaggacaagattttcaatgaatgacagtgccgcgtaagatacggtcatgaacgccaatccgagtacgatcagttttttcattaacgattgcttttgcccgattttgcttcctgttgtataagacgtaacacacataaccaaaagcggaatcgctaaaatcaagccttttttcacgccgtcggtgtcgtatgttttttcaagaacatctgataggtaaaacaggatgccgaataaagtaaacaaacaggtcgcaccggctaaataagcggtaaacagccatctgccttcatgtttaaaaacacttaacagccctttcgcatattttccgataggtggcggttctttttcctttttcttctctttaataaaaatccaagtcagcacgattgaaatgatacaaaacacagggaaggcaaaaaacgcgccataccagacaagcagggcgataagcgagccgatgatcggtgaaagcactttccccatgccgtttgaagcttcaacaaggcccagcaccttgctctcctgggcgcctttaaacagatctcccgtcagtgccatggcaatggggcctgttccggctgccccgattccctgaagcgctcgtcctgccatgacccaaggaaaggcattgtcaaaaaaacctgccgcaaacccggctaacaaaccgccggcaccatacaaaattaagcagggaataatgatgattttccttgagaatcggtctgcgagataaccgacaatcggaatcgcaaatgctgcaatcaaggaaaatactgtgatcacgagactgacttgaaattgtgataaatgaagttcagatttcatttttggcaaaatcggaataagcatcgagtttcctagggttaatattaaagggattgaaccgattgctacaatcgtcattccgttattttgttttgatgattccatctcagagcacactccttttcttctgcttagaatgtccctgatggcttcgtttattcagcgatcagacagcaaaaaaccgaacagaagatacctgttcgggaaaaaagagggttaaccgagagcctgtgaaatcaaagcatataagtgtccattttgaataggcgcttttttctgatagaacaaaatcggaggttcatcatctttatgaaatcccatttctatcaggctgtcatgcagagacgtgtgttcactcggtatatcgattcgcatcggcccttgtttgccggccgccagccttgtaattatctgtgctgcaacatctgatgatggagcgatgatagggccgaatttcaaattggccggtgtctgtacagaaagtccgtagccaatgagctgtccgtcctgatttctggcgatgatacattcgcatgaagcagaaataagctgctgcaaaaggtttgatcgatctccgccaaaggcagccagatccgccgcggttaagtcgtgaaagtcttgttctctaaaggatgtcagttcagcatcaagcttttttgtataaggttgaaaactgtgacagctgtactttcgcactgaacctgccgtatgaaaacctgctttttcataaagcggcaaaccttcttttgtggcgcaaagcctgatggcggtgttttcatccgtttgggtaatacaggcgtttaccatacgccggccaagaccgagccgttgatattctttgtcaacgatcacgaggccgatagaagcaagccggccaaacaaaaacaagccgatgcaggaaataatatcaccgctgacattttgatagccgaaaaagcgtccttgctggacaagcagtgccagctcttgttcgccgtaatccggccacccggcttgcctgcaaagccgcaatagactagggatatgttcttcatgaagcttaatcagctcatcgattaccctcatacagatcacctgcttgtttcgagttttttatacatgatgatatgtgtgcctatgccgggaatctcaaacggttcgccgagttcttcccagccaagctttgaatagtagcctttcacatggcttctggcattgcaccagactgcctgaacgccgttctttgccagtttctcttccgcgtgtttgatcagcgtgctcccgcctttttgatcacgatatccttcaagcgttgccatgcctctcagccgatatgctggggattctgttattaatggctgattttgcggggaaaaagaagcgatgctgatcagctttccttcaaaaaacgcgccgagatgaaaggagccttttgcatgatcctcttcatatttgcattgttcaatggattgatggggacgcagaatgcggtgccgaatttcatatgtatcttccgcggaaatggttttgacttcgagcataatgttcctcctcatgactgtttttctatatcgtaacacgaatcccgttgaaaaagaccgcccgattggatcagacagtcttttaagggattaatgcaaaaagatattttggcgctgctcatctttttgctgaatatatgaagtgagctcagcggttaagtcagatctgaggaaaggcgttatcaagtagatgccgttaaacagctcgcatgccgtatccagcagggagcgtgcaattgcaaggccttccgccttttgcttttctttatcttcaccggcatgggccattttttcgcgaatcgtatcagacagcttaatgccgggaatttcattatggatgaattcggcattccggctgcttgtcagcggcatgatgccgatatagatcggcgtcttcagatgttttgtttcgttatggatatcgacaagctgctgctcggaatagacaggctgagaaacaaaataatctgcaccgcaatctatttttttctcaagccgttttaccgctttatccagatggcggacgttaggattaaatgcggcggcaactgagaaattcgttttcttgccgagcggttttccagacagagacagaccttcattgaattgtttgatcagcctgattaaatcaaaagatgttaaatcatatacagacgtcgcaccaggaaaatccccgattttagaagggtcacctgtaatagcaagcacgtcattcagccctaacgtatcaaggcccattaaatgtgactgtaagccgataatgttacggtcacggcacgtaatatggacaagggaacgcatatcgagctgctgcttgacaagggcaccgcaggcaacattgctgatccgcggggtcgccaaagaattgtcggcgagtgtcagggcatcgattcccgcttcttttaattcagcagcagcggacagaaatttgtcaaagctcagttttttcggcgggtccagttctacgataatagagcgttttttcgctgcgatctcatccaggccgggctcggttcgctcgtgatgaacagaaatgaattctttggcccgggttttgacttctttttccgtaatcggagccagtccgccaactgcttccgccatcgccctgatgtgattcggcgttgtgccgcagcagccgccgataatccgcgcaccttgcttacggaattctgacgcgctgttttgaaaatacgtgccgtctgtttcatagacgagccgtccctcttcaagcgaaggaagactgctgttcggataaacggataagaatacgtcatcaaaaattggcacttcgctaagcgcttcaatcatgtgataaggcccgagccggcagttaatgccgacgatatcagccccgagatccgcaatcgatcgcaatgcttcagaaagaggtgttccgtcctgcaatacgccttgctcgtgcatggagacattgagcattatcggaagatcagtctctttgcgcgcgattttcagcacttcacgggcttcttccaaatcataatatgtttctaacagcaagccatccggctcttcatgcagcagcagatacagctgctcgcggaagctgcgcttaatttcgtcaagactgtacgcgtttttattaaatgtgcgtatgccgcccatcgttccaagcacgtatgcatcgcctgctgaagcccgcgcgatctttacggcctcctgattcatttttttgatgtcatcctcaagcccgtgtctggataatttaatatagttggccccgtacgtattcgtttgaataatgttggctcccgcttcaacgtacgctttatgtatgcgctgaatttcctccggctttgaaatattgagctcctcaaaacacctgtcaatgccataggagtagaggagcgtccccatggcgccgtcaccgattaacacctgtctttgcaaatcttctaaaagtcccattgtctgcctcctttattcacatcagcaaggaaaaaagagaaataaaaaaagtcctcttaagaagaagactttgtcagtgattttgtctcttcttatcttccaagctgttcgagcttgctggatttagcaccttggtcatggctgatcgccattacaccggttgctgaagcttcgtcgggccagtccctctgcttctcttgataagaacggatatgaaattttcgtgtcaggaagtgccaaaagatatctggcgtttttccctttctccaaatttaccgaaaataaagacaataatcaataggaatcagaaaatttatctgaaatttataaattgaacgtcaattggcagatctgctccccgtacagctgagataatctgctgcaggtcatctttgttttttccggtgacacgcacttgatcatcctgcacctgagactttactttcagtccggagtttttgatgatcgtattgattttttttgcgttgtccttgtcaatgccttgaacaagctttgcacgctggcgcaccgttccgcctgacgcgttttcaaccttgccgtaatcaatgttttttgtcggtacgtttcgtttaatcaatttgctgaccagcacatctttcagctggcttaatttgaattcgtcatcggaaacgaggaccagctcctctttatctaaagaaatgtcgcttttgctgcctttaaagtcatatcgggtactgatttccttcagtgcgatttggattgcgttttgcacttcaggcaattccaccttggatacaatatcaaatgaactttcttttgccatatgaaaacctccataacatttaacttatgtgttgattatagtagaataaagagaaacttccaacagaacaaagaatcaatttgtgatgattggaaaaaatgttaacaaaatccgcagagaataagcggaacaggaaggacgatagcatgagaccagggcagcaattaaccttgagtatagatcaccaaaccgacttcggttactttttaaccgatggggaagatacgattctcttacataacagtgaaatgactgaggatatcgaggacagagacgaagtagaagtctttatatacgtagaccagcaggaaaggcttgcggccacgatgaaaattccgatcatcagcgcggatgaatatggctgggttgaagtggtggataaagtggaagatatgggcgttttcgttgatgtcggtttatcgaaggacgcactagtcgcaactgagcatttgccgccgtacgaagatgtctggccgcaaaaaggggacaaactttactgtatgctgaaggtgacgaaccgggggcgcatgtttgcgaaaccagcgccggaagatatcatcagcgaactgtttaccgacgcttcagaagatctgatgaataaagagctgacaggtacggtgtacaggctgatcgcatcgggttcattcgtgatcacggatgacggtatccgctgttttattcacccgtcagaaagaaaagaggagccaagactgggttcaagagtcacaggccgggtgattcaagtgaaagaagacggttcagtcaacttgtcgctgcttccgagaaaacaggatgcaatgtcagttgatgctgagtgcattctaacgtatatgagaatgagaaacggtgccatgccgtacagtgacaaaagccagcctgacgatatcagagaacgttttaatatgagcaaagccgcctttaaacgcgcgctgggccatttgatgaaaaacggaaaagtgtatcaggaaaatggatggacatacgagaaaaaatagcatgaaaacggctcgcctgcagcagactgcggagcgagccgtttttttatgtctagtttaattcatcaaccagcgttctgattgccatttcgcgatccacattgtctgaaatcgcaatcggcgtaatatcaatggcgagaatgatcagaatcagggcacctgctgcagcaacataagaaacataatagaaatagttagcggtatcaacagtgttgacaagctcggcctgaactctggatgtatcatccttagaagcggcgatttcctttgcagcttctactttttcttcaacgatttgacctgcttttttcagcagttcatccactttcaatgcatctttgctgtaaacagctttcttcaggttatcaaaaaagtcagcatcctcttttttaatatcagcgacaacctgattggcaaaagcctttgcctgttttgtgttgagtttgtctgtcatcgctttattaaagacctctggaagctgtttgccaacttccccttgggcaaacacaaagcctttaaaaatttcctcacctgaatactcaagctgctttgcctgtgccacactttcttgctgcttcaccaaaaacacagtcgtcaccaatacaaccgacaaaaatactagaaacgccttcttcaaactgaaacctctcccttcttgtgttttttattccacaacagtctgcgaatatatgtaaattgaatcgtggaatcgataggagtgagatacaatatcaaaatgccggccatgataatcgaaaaactgatgaggcccagcatgactgcaaaaatctcatgcataaaaacagcgatgatcaaaatcaatctccaatgcttcttcggcgcaaacagtgccgcgaagatgacaatttgaaccagcagcgtcccccatgtcggaatcaccacgaacggacttgttacaattggcttcgttaacgcctgaaaaaagccgttgaagccaatggttttttcctgggcgaaataatagacggccgttccgtccacccattcctgctgagatagcttagcgacggtagagtgaaaataaagcaccgccacttggattctgatcacaaaataagaaataaaagctgttatttttccaagtgttcttttgccctctataggtctcgtactccaatgccattttctcggatcggtcagcgtgatgggaagcaataaaaaggtcatgactgctgctgcctgctcgcctccgtcgatgacgatcagcgatgactgcaggctgtaactgacataccaatgcagaaccccggtgattctggggcgccagccaatgacaacaagcaccagaatggcaatgcagacccatctgaaaagatttaacatcatatagttattttcgccgagacaaaagagactgagattcattttacaagctggatagctgctgatcccgctggctggcttcataatgaggctcgggtgattgatgagcagcgtcagcaggctggatagcgcaatgatgcttcgcgcgaggccatatacatttgtccacgggtttctttcgtcccatctggtgatggtctgttttatgttttcgagcatgagatcacaaccttgactatgctttttacctgataagacgaaggggtatatttagaatagctccaaggaacaatatcctctttcgtcaaatagtagctgccacaaagcagcgggcggggagcgggtgtttttaattgcacggttttggctttgcttttgcatgcgccgaggtccttttctttacatgctgtccactgttccttgccgacttggctgtagatcacgcccatttcaacgccttgtgaccgcccataccgatacaggccgaataggttgtcagccctcatattgggccatctgaccttggcgctggcattttcagcctcatataagccgattgcagtatcacgcggatttttgctaaaaaagccccagccctgagggaggatgctggacatgagaaatttggagtcctttgtcagcggaatcggggttgtccctaagctgccaataatagaaaacagaaatagcgaaccccaaaggattgaaaaaatgacaaaaaatgatatcgatttctgcattcgactgctccttttaacctgaagaatcgtttttacacttttcataatataaaaacatttatgtaataaaaaggttaaaaagtatgagaaattccatttttgttaaaaggaaaaacaggacattttacactgctatatgtgattgatatatagtgtttttttcgatatatttaaaccatgaaaacgaatcaagttaatgaccgctggattgttcaatttcgaaaagggattttcgagctggccatcctatccctactgcattctaaaccgatgtacggttatgagctgacgtcatccttaaaaaccacctcggctctggctatttcagagggagcgatttatccgattctgaaacgtatgaccgagaagggatggatcgaatttttttgggaagattcactggacggcccgaaaagaaagtattacaaaatgacacaaaaaggagaagaaatgttaaaagaacggctggagaaatacctggaaacccatcaagccttactgtctttatcgggggatttgctatgaatggacagcttatcattgaccgatacatggaggaactaaatgcagagctggagaatatgcctgatgtagagagagaaaacgctatcgacgaattaaaggggcatatcaccgctttcgttcaagacagaatcaaagccggccttagtgaagaggaactgcaggaagctgttgaatctgaattttctcatccgaaggagcttgccgaattgatgatgggtgatgggggagagacgaaaaggaggaggtctttattgggcaaaagctggctttcggtccttctcattgtcacgattatcgccctgccgctgctgccgtccgacttcagacatctgccgctggctgtttatttaatggtgctcgccggatatgtatggaagcggaaaaaattgatgatgtttgcaggtgtcagaaaaaacaaaatgcgctctcaaaaggagattgttacgatttcgcgagtcggtgcggtttatctgctgtttttagcagtggtgcttcttttgagcccgttcctcaatgcgcttgtcgtcctgctgctgattgcagtaagctgcgccgctttttttctttttcttaacatcaagtaatcttgtaggaggctgtaagatggaaatcagcatcaattatctattaattgtcatcgcgcttttattctttgtggttgcctattttgtcggaatcaaaaaacaaacctggatgctggctgggtttaacgaggcgcgtatacgggataaagaccggctggccagaatagcaggctactttttcttgaattccggtttgttcattttgctgaatagttttatctcatttcaaggtcaggagcagctcatacctccgcttatactggcatatggagcaggggttattatttatgtcaataaaaaattagtagagtagaaaaagaagggcagagcgaaatatctctgcccttcttttttgggaaaataagaacgaagcaccacatacaagtttttgtatttttgataggatgaagaaaaatggtagattccaaaataggaaggatgtggtgttttgcgcaacctgaccaagacatctctattactggccggcttatgcacggcggcccaaatggtttttgtaacacatgcctcagctgatcaaagcatcaaatacgaccatacgtatcaaaccccttcatacatcatcgaaaagtcaccgcagaagccggtacaaaacacaacccagaaagaatcgctattttcctatcttgacaagcatcaaacgcagtttaagctcaaagggaatgcgaacagccattttcgtgtttcgaaaaccataaaggatccaaagacaaaacaaacgttttttaaattaacggaggtttacaaaggaattccgatttacggctttgaacaagcggtcgcgatgaaggaaaacaaacaagtgaaaagtttctttggaaaggtgcatccgcaaatcaaggacgtctccatcacaccgtctatttctgagaaaaaagcaatacatgcagcaaggcgtgagctcgaggcttccattggaaaaatcgaatatcttgatggggaaccaaaaggcgaattatatatctatccacacgacggtgaatatgatctcgcctaccttgtgagactctcgacatctgaacctgagcctggctattggcattatttcatcgatgccaaaaacggaaaggtcattgagtcctttaatgccattcatgaaacggcaggtacaggaatcggcgtatcaggtgatgaaaaaagctttgacgtcagagaacaaaatgggcgcttttatttggctgacgaaacaaggggaaaagggatcaatacatttgacgcgaagaacctgaacgaaaccttgtttacgcttttgtctcaactgatcgggtatacgggcaaagaaatagtcagcagcacgtccgtatttaatgaacctgcggctgtagacgcacacgcaaatgcgcaagccgtttacgattattacagcaagacatttggccgtgattcttttgatcaaaacggagcaaggattacgtctaccgtgcatgtcggcaaacaatggaacaatgctgcgtggaacggtgtccagatggtatacggggatggagacggttcgaaatttaagccgctgtctggatcgctcgacattgtcgcgcatgaaatcacacacgcagtcacacagtattccgccggtcttttatatcaaggagaacccggtgcattaaatgagtccatttctgacattatgggcgcgatggctgaccgtgatgattgggagatcggcgaagatgtctatactcctggtattgcaggagattcattgcggtcattggaggacccatctaagcagggaaatccagatcattactcgaaccgctacacaggaacagaggattatggcggagtccatatcaattcgtccattcacaataaagcagcttatcttcttgcagaaggaggcgtgcaccacggtgtacaggttgaagggattgggcgtgaagcaagtgaacaaatttactatcgggctttaacatattatgtaacggcatctacagatttcagcatgatgaagcaagcggcgattgaagctgccaatgatttatacggtgaaggctcgaagcaatcagcttcagtcgaaaaggcgtatgaggctgtcggcattctatgagcaaacaaaaacagtcaggacacagagtctgactgtttttgtttgctcattttcttaaaaagaatatcgccaatgtacctggaccggcatgcgagccgattgctgaactgattggatgcataatgatttctttcggcttgaacgcttcctcaatcaggtgtttcatgtccgtggctttttctttgttcgcggcgtagctgatcccgacggtttgatcgctccaatcatccccgcgctctttcataagctcgatgatccgtttgaaaagtttcttctgtccgcggattttttccagaggcacaagcttgccgtcctccatctgaagcagcggtttaatattcaacaggccgccgacaaaagcggacgttttggatatccggccgcccctcgcgagatatgttaaatcatcaacggtaaaaatgtgttcaagctggctgcaaaagttctttacagacgtttcaatttcttgtattgtattcccgttgatacagagatcggcagcatgccggacagccagaccgtatcctaatgaagcgcatttggaatcaatgacccgcaaatcgaaatcggggaattcctccttcacttcattggcgatcattacagctgtctgatacgtgccggagagacctgaggaaaaggcaatgtaaagagcgggatcacctgtttcggcatattgcaaaaacacatttttaatcgtttgcggtgaggcttgggacgtcttaggcgtttctccattttgcatcgcttcaaatatttgatccgcatgaattgtgactgcatcttcgaattctttatcgccgagagaaaccctgagcggaataaagccaatgcctttttcttcaaaataagaacgaggcaaatcagtggcgctgtcagcgatgagatgaactgtcatattgcttcccttctttccgttatcgctcgttatcatgagagttaagccaactatatcatattaatttgccaaaatcgtgttcaaatatttgttttaagggaaaacataataaagaagaaagagcggaggaacatgccatggtactagatcaaacaaaaaaattactcatcgtcatcatcggcgctttactcaatgctgccgggctgaacttatttttgattccagcagatgtatatgccagcggatttacaggtgttgcccagcttttatcaagcgtcgttgatcaatatgcccccttttacatatcgacgggaacgctcttgttcctcttaaacattccggtcggtattttaggatggctgaaggtcggcaaatcgtttacagtgtacagcattttaagtgtcgcactcactactctgtttatggggatcctgccggaaacaagcctgtcacatgacattttgctgaacgcggtgttcggcggcgtcatttccgcagtcggtatcggcttaacattaaaatacggagcttcgacaggcgggcttgatatcgtcgccatggtgcttgcaaagtggaaggataaacccgtcggcacgtatttcttcattctgaacgggattatcatcttgacggcaggattattgcaaggttgggagaaagcattatataccctggttacactatatgtgacaacgagggtgatcgacgccattcacacccgccacatgaagcttacggcaatgattgtgacgaaaaaagcggacgaaatcaaggaagccatttacggaaaaatggtgcgcggcatcacaactgttccggcaaaaggagcttttacgaacgaacagaaagaaatgatgattatcgtcatcacgaggtatgaactgtacgatttagaaaagatcgtcaaagaagttgatccgaaagcatttacgaacatcgttcaaacgacagggatttttggtttctttagaaaagactgacgaaagcaggtggaagtcgtgaaacggctgcttgtgatgctcctccccgtgctgcttttgataggctgcgggaaagatgagcagacagaacccgataaggaggtatcaggcggaatggagaatcaagaggttgttttatctattgacgcaattcaggagcctgaacaaatcaagtttaacatgtcgctgaagaaccaaagcgaacgtgctattgagtttcaattcagcacagggcaaaaatttgaacttgtcgtgtatgattctgagcacaaagaaagataccgttattcgaaagacaaaatgtttacgcaggcttttcaaaacctgacgcttgaatctggagaaacatatgatttctctgatgtgtggaaggaagtcccggagcccggaacctatgaggtaaaggtgacatttaagggcagggcggaaaatctcaagcaggttcaggctgttcagcagtttgaagtcaaataagaggctatggcgagtcgccatagcctttttttattggagtttgtccagctgattttgaaattgatgcagctgttgacgttccgcatctgtcgaattggcatacgcagaagatacagcatttttggctctcagaatcgcttgctcctgatcgccttcctcaaagccgtttgtcaccatgaccgcctgttgaacaaatgattttgcctgctgaaacagttcatttctcatttaatattcaacctggctttcggccgagtctcgtgccgcggcatgctggtgagcttcttctaaagtagaccgatatggaaatcttgcggcgtgtagcccgatggagtctttaccctgctgaataaaccttctggatttgcttcgtttacccattttgagactgcccccttccatactttgacgagatgagtcgtcttcaatagtatggtggggcaaagtaaggtttatgagtgggaaaaattaatacggaccttctttaaagtgagaaatattctttcaaaaatcttgcaacgccgtcctcttcatttgtagccgttgttcggttggcaatctgcttgaccgcgtcaattccatttcccattgcaacgccgcagcctgcaaattcaagcatttccaaatcgttatcctcatccccgaaagcaatgatccgctccctcggcacgccgtaataatcgctgattttctgcaggccgaccgctttattcatgccgcttttgataatttcaatgacatgccacggtgcggcccatcttctatggtcgattacctcggcatgcacatccgataaatatgagcgtattgccggcacatcttcttcttttgcatgtatgagtacagacgtcacatcttcaccaagattttcccgcaagtctccgaccgttacatttgttgtgttcatgttaaaggcatctatcaggtgctcatcatggtaatgaaagtatacgtcgtcaatcacttcagcaagcacgttatgtacgttgtagctctcgctgatatccacgagctgtttgacaacatcaagcggcagtgacgtatgataccgtccccagctgtcgtcttgcggatgatggacaaatgctccgttaaaattgacaattggcgttgtcagctccatctgctggtagtacatggaacttgaacgatacggacggcctgttgagatgcagacataatgcccgtcatcttttaggcgctgtatcgtatgaagggtgttttcagatatggttttatcatcctttaataatgttccatctaaatctaatgcgattaaatagggttttgtctccatgaaaagctcctttaaccttagattttgcttgttttgccttacttacagtgtagctttttaccatctttattgtctacatgttacacttatgattatggttatcctaaggaggggcacattgtgatacaaattgagaatcaaaccgtttccggtattccgtttttacatattgtaaaggaagagaacaggcaccgcgctgttcctctcgtgatctttatacatggttttacaagcgcgaaggaacacaaccttcatattgcttatctgcttgcggagaagggttttagagccgttctgccggaggctttgcaccatggggaacggggagaagaaatggctgtcgaagagctggcggggcatttttgggatatcgtccttaacgagattgaagagatcggcgtacttaaaaaccattttgaaaaagagggcctgatagacggcggccgcatcggtctcgcaggcacgtcaatgggcggcatcacaacgcttggcgctttgaccgcatatgattggataaaagccggcgtcagcctgatgggaagcccgaattacgtggaactgtttcagcagcagattgaccatattcaatctcagggcattgaaatcgatgtgccggaagagaaggtacagcagctgatgaaacgtctcgaattgcgggatctcagccttcagccggagaaactgcaacagcgcccgcttttattttggcacggcgcaaaagataaagttgtgccttacgcgccgacccggaaattttatgacacgattaaatcccattacagcgagcagccggaacgcctgcaatttatcggagatgaaaacgctgaccataaagtcccgcgggcagctgtgttaaaaacgattgaatggtttgaaacgtacttataaagcacgaagttattaacaagagctgaatttacgttatactgtagaaaaaaggagtgagggaacgtggaagaagcattaaaagaaaacatcatgggcgccctggaacaggttgtcgatcctgagcttggcgttgatatcgtgaaccttggtttggtatacgatgttgacatggatgaagacggcttaacgcacgtgacgatgacactgacatcaatgggatgccctttagcgccgattatcgtggatgaggtgaaaaaagcattagcggaccttcctgaagtgaaagacacagaggttcacattgtatggaatccgccttggactagggataaaatgtccagatacgcaaaaattgcgcttggcattcaataaaacaaaagaggacagcctgacatgtgaggctgtccttttttacagctgaaaggagtgaaaggaaatgatgtacctgctggcagttttatgcccgccgcttgctgttttgttttcgggaaaaccgtttcaggccttgctgaatctcatattgacctgtatcttttggctgccgggcgcgattcacgcctgctttatcgtcgccgaccgccgtgccgaaaaacgggcaagaagataatttgggaaaatgaggatgcagtcatggtataatggtcataaaaacagcagggagagcactatgaaaaagaaattgcttgcattcgcgctttgtactggcgcgtatgcggccctgtttgcgtactctgtgcactcagagcaaaaaacagacacaagcgagatgacggatgtcagccgcctgatgcctgtaaaaataaagcagacagtgaaagggcaggaagaggaaacgctcattgacacagtcaaagaggcaaatcgaaaaaacataaaaatttcaatcgccggggcccagcactccatgggcggccatacatattatgaggacggcatcgttctcgacatgacgggctacaacaaaatcctgtcactcgatcaagagaagaaaaccatcagggtgcaaagcggtgcaacgtggaatgatatccagaaatacgtgaatccatacggactcgcggtaaaagtcatgcagtcacaaaacatttttacaatcggcggatctctcagcgcaaatgcacacggacgtgatattcgctacggctcgctgattgatacagtcaaatcattccggcttttaaaagctgacgggacgattatcactgtcactccaaaagatgatttgtttacggcggtcatcggagggtacggcctttttggcgtgattcttgatgtaacgcttgagctgacagatgatgagctgtatgtcatgaagacagaaaaaatgaattacagcacatactcagactatttttcaaagcatgtaaaaggaaatccagatgtccgaatgcatctggcgcgaatttcaacagcgaaaaaaggatttctgaaagacatgtatgtcacaaattacgtattggctgatcatcaggatcagctgccatcatacagcgatctcaaagaagatgagtatacgggagccacaaagtttgcactcggtttgtcaagacagtatgaatggggcaggaattggctgtgggacacacagcaatcctatttcctgagccaaaacggcacagagatttcacgcaataacgtcatgcggtccgaatcaaagtttcttgagtatgaaaacaatgacaacacagatgttttgcaagaatactttgtgcccgtgaaggagtatgggtcctatattgatgacctgagacaaacgctgtcggacgaagatctgaacctgctgaacattacgatccgctacgtgcagaaaaatgaaaaggccgacctttcctatgcgaaggacgatatgttttcgctcgtgctattaataaacgagggcttttcaaaagaagaccaggcagataccgcccgaatcatcaggcgcatgacagacgttgccatcaagcacggcggcagctattatctgccttatatgacctaccagacaaaagcgcaaatgagacaggcatatccgaaaagtgaagcgttttttcagaaaaaacgaacctatgacccgaatgagcgctttatgaattacttttatcagaggtataaataatggggaaaaacaaattaaaatggctgacattatcacaaagcagcgtgtttttcgcaagcagcttaatctttccgttttatattctgtttgtgaaaaatatcggctcaagctacacacagttcggtttttcctacggattgttcgggttgagcggagcgctcatttacccgctcctcggacggctgtctgaaaggtttgacagccgttattttctgcttctgaactcgtgggggatggctgttctgcttttatatgtcccgcatatcggaagcgtcgttcaagtgtatatcgtccaagtgctgttagggctctttggagcgatgcaaaagcatggagaaaaagtgctgatcgctaattttacagacagcggagagcgtggaaagaagattgggaattaccatttttggacggctgtcttttcagcagcagcaattatgcttgggggctttctcgctgactttttcacagtgcaaatgattttttatgcaagctctattctatattttttgagtggattgatgatgatgaaaacaggctgacgcggtcagcctgtttttttatgcggctgaaaagcggtgctgcatcaacgtttttgtgctggagttgtgctgatttttttgagcggaatttccattgaacagaaaatttataaatgaataaaaatattaaatatacgattgaattaatttttattcatgttataatgttaaataatttcacaaagaccaagagggtgaacttgttttgaaaataggaattgtaggtgctacaggatatggaggcaccgaacttgtcaggattctctcgcatcatcctcatgcagaggaatgcatactttattcatctagcggagaagggaatgtctatagcgagggttatcctcatcttaccggcttagcggatcagaagctgaagccgattgatatgaatacgatcaaacacgaaatagatatcatgtttctcgctgcgccgcccggagtctcaagtgaattgactccaaagctggcagatgtgggaattccggttattgatctgtcaggtgatctgaggatacaagaaccggctgaatatgaaaaatggtataaacggacagcggcaccgaaggcggtgatacaagaggcggtatacggtctggcagaactgaatcaactgcaaattcaacaggcgaaactcattgccaatccaggctgttttccaacagctgttttgcttggcctcgcgccattggctcaaaagaaactgctcgatgaatctttcgttatcgttgacgcgaagacgggtgtttccggagcgggaagaaaagcatccatgggaacccatttttctgagctgaacgacaattttaaaatttacaaagtcaatgaacatcagcacacgccggaaattgagcaggcgctgaatgaatggcagccaggcctcgggcccattacattttcggctcacttggttccgatgacaaggggcatcatggcgacgatgtataccagattaacctgtgatctatcagcagatgacctgcatgatttatattcggaattttaccaagattcatattttgtgagagtgaggccaaaaggtcagtacccgcaaacgaaagaagtgtacggcagcaatttttgtgatatcgccgtgaccctcgatgagagaacgaacagagtcacgatcgtctcggtaatcgataatttaatgaagggtgccgccggtcaggcagtgcaaaactttaatttgatgaatggctggaatgaagaaactggactcactatcacgccaatttatccatagaacgggagagaatcgaaccatgattcagttaagtgaagatcaaattgtaaaagtaacaggggatgtatcctcgccaaaagggtttcaggcaaagggtgtgcattgcgggctgcgctactcgaaaaaagacctcggcgtcattatcagcgagacaccggctgtgagcgcagcagtttatacccaaagccactttcaggctgctccgatcaaagtgacactagacagcttaaagcacggaccgacactgaaagccgtcatcgtcaacagtgccattgccaatgcctgcacgggagaacaaggcctaaaggacgcatacacaatgcgggagagttttgcttcacagcttggcattgagccggagcttgtcgctgtttcatcaacgggtgtcatcggcgagcatttagacatggaaaaaatccacgcggggatcgagctgctgaaagaaacacctgcgggatcaggcgattttgaggaagcgattttaacaactgatacggtgatcaagcagacgtgctatgaactggcaatcggcggcaaaacagtcacgatcggcggagcggccaaaggctctgggatgatacacccgaacatggccacgatgctgggatttgtgacaactgacgcggcaatcgaagaaaaagcgctgcaaaaggcgcttcgggaaatcactgacgtttcatttaaccaaatcacagttgacggagaaacatccacgaacgacatggtattagttatggcgaatggctgcgccgaaaacgagtgcctgacagaagaccatccagactggccggtctttaaaaaagcgctcttgctcacttgtgaggatctagctaaagagattgccagagacggagaaggcgcgacaaaactaattgaagcccaagtacagggagcgaaaaacaatcttgatgcaaacgtcattgccaaaaagattgtcggctcaaatcttgtaaaaacggcagtatacggaacagatgccaactgggggcggatcatcggagccatcggacactccgcagcacaggtgacggcagaagaagtagaggtttatcttggcggccaatgcctgtttaagaataacgaacctcagccattctctgaatctatcgccaaggaataccttgaaggagatgaaatcaccattgtcatcaagatggctgaaggggacggaaacgggagagcgtggggctgtgacctgacctatgactatatcaaaattaacgcgagctatcgcacgtaataaaggggagcgaaatgaagaaaacaatcgtttttaaatgcggtggaagtgtcatccgtgagctgtcggaggaattttttcaaaatctgaaagagctgatggcgtcaggctggaagctggcgatcgtacatggcgggggaccggaaatcacgaatatgctgaaacggttaaatatcaagacagagttttcgggcggacagaggaaaacaacgaagccggtgctggaagtggcggaaatggttttatccggttctgtcaataaatttttcgttgctgagcttgccaaacacggactgcgagccgcaggcatttctggtaaggatggaggtcttttggaggctgattatctagatccggaaacatacggagaagtgggagaaatcaaaaaagtcgatgcgtccatggtgaacgcgctgatggaaaatggcatcatccccgttattgcgccgctgtctatgacaagcgactgcaaaacgctgaatgtaaatgctgatctggctgcttcagcagtcgccggagcgcttgaagccgataagctgatgttcgtcacggatgtcgatggaatcatgaaggaaaagcaacgtctggacgtcctgacccctaaggagattcagatgctgatcaagcaggaagtgatcaccggagggatgatcccgaaggtcaattcagccttgtcagctttatcagatcaggtgtctgaagtcatgatcgtaaacggaaaaggttcattcttcgcagaacaaacctttcaggggacaaaaatcgtcaaagcaaaggaggctgtttcatgagcagcttgtttcaaacctacggccgttgggatattgacatcaaaaaagcaaagggaacgtacgttgaggatcaaaacggcaaaatgtaccttgatttcattcaggggattgcggtatcaaatctaggacactgccatgaagcggtgacagaggcagtcaaaaaacagcttgacagcgtatggcacgtatccaacctgtttcaaaacagtctccaagagcaagcggcgcagaagctggcagcgcatagtgcaggagatcttgtctttttctgcaacagcggcgcggaggcgaatgaaggtgcgataaagcttgcccgaaaagcaactggaaaaacaaaaatcatcacttttcttcagtcgttccatggccgcacgtatgcagggatggctgcgaccggacaggataaaatcaaaacaggcttcggcccgatgcttgaaggctttcactacctgccatacaatgatccttctgcttttaaagctcttggggaggaaggcgatattgccgcggtgatgcttgaaacagtgcagggagaaggaggagtcaatccggcgagtgctgaatttttatcagccgtacagtcgttttgcaaggaaaagcaagcccttctcatcattgatgaaatccagaccggcatcggacggacgggaaaaggcttcgcatatgagcacttcggactctcaccggatatcatcacagtcgccaaaggattgggaaacggctttccggtcggcgctgtcatcggaaaaaaacagcttggagaagcgtttacccctggttctcacggaacgactttcggaggaaacatgctggcgatggctgctgtgaatgccacattgcaaattgtattccagcctgactttttgcaagaggctgctgacaaaggggcgtttttaaaagaacagcttgaggcagagctaaagagcccttttgttaaacaaatccgaggtaaaggattaatgcttggaattgagtgtgatggcccggttgctgacattattgctgaattgcagacattaggcttgcttgtattgccggccggcccgaacgtgattcggctgctgccgccgctcaccgtgactaaggatgaaatagcagaagccgtcagcaagctgaaacaggcaatcgctcatcattccgctgtaaaccagtgatttttttttcgatgtaaaggcataaaaattcatttttataattaattattcatcaagaggtgggctgttagatggaaggttatttagtgttagaagatgggacatcgttcagcggcgagctggacggtcatgaaaactgtacgggagaagctgtttttttcacaggaatgacaggctaccaggaagtgctgacagatccatcatataagggacagattattgtatttacctacccgctgattggcaactacggcataaatgaaaaggattttgaaagcaagaaaccgcaagtaaaagccgcggttgtctatgaggcgtgtgatcacttttctcattatgaagcggtatacagcctcaaggagtatttacagaaatggaacattccgctgttaacccatgttgatacgagggctgtcgtgaagaaaattcgggcaaacgggacgatgggtgcaacagtcacagcctctaaagaaggagctgagattgcccttcaacccgagaatgtggcagagcaggcttcagcccaggaaatcagcacattcggcgacgggaataaacatatcgctctcattgattttggctataaaaagtcaatcgcatcatcacttgtcaaacggggctgcaaggtcaccgtggtgccatacaagcaaatggaggccgtatacaacatcaaacccgatggcattgtgctatcgaacggacctggagatccgaaagccattcagccatatttaggaaagatcaaaagcatcatcagccgctttccgactctcggcatttgtctcggacatcagctgatcgcgctcgcgtttggagggaatacttttaagctgccattcgggcacaggggagctaatcatccggtcatcgaccgtgagacgaaacgggtctttatgacaagccaaaaccacagctatgtggttgatgaacagtcgattaatgaagaagagctcacgatcaggtttcatcatgtcaatgatacgtcagttgaagggcttgcccataaaaaactgcctgtcatgagtgttcaattccacccggaagcccatcccggacctgcggaaagcgaatggatttttgatgattatctaaagaatgtgataccagcaaggagagaaatcgcgcatgcctaaagacaccagtatttcaagcatattagtaatcggctcaggcccgatcatcatcgggcaggcggcagaatttgattattcaggcactcaagggtgcatcgcgctgaaggaggagggctaccgggtcattctcgtcaacagcaatccggcgacaattatgactgatgaagccttcgctgatgaaatttattttgagcctctgacagcagaaagcctgacagccatcattaagaaagaacggcctgatgggcttcttgccaatttaggcggtcagaccgcgttgaatttagcggtggagcttgaagaaacgggtgttttaaaagagcacggcgtcaaactcctcggcacatccgttgaaacgatacaaaaaggagaagaccgggaaaaattccgttcgttaatgaatgaattaaaacagcccgtgccggagagtgaaattgttgataacgaggccgatgccctccattttgcggaatccatcggttttcctgttattatcagaccggcttacacattaggcggaaagggcggaggaatcgcccctgataaagaagcctttacagctatgattaaacaggcgctattagcaagcccgatcaatcaatgccttgtcgaaaaaagcattgccggctttaaagagattgaatatgaagtcatgcgtgacagcaataacacatgcattaccgtctgcaacatggaaaatatcgatccggtcggcgtgcatacaggtgactctatcgttgtggcgccttcacaaacattgacagatgaagactatcaaatgctgcggacggctagtctgaccatcatttcagcacttgatgtcgtaggcggctgcaatattcaattcgcgcttgatcctttcagcaagcaatattacgtgatcgaagtgaatccgcgtgtcagccggtcatcggctctcgcatctaaagcgaccggttatccgattgcgaagatggccgcgaaactggcagtcggatacacacttgacgagctgaaaaatccgctcacaggctcaacttacgcaagctttgaaccggcactggactatgtgatcgtcaaatttccgcgctggccgtttgataaattcaaaaacgcagaccgcaagcttggcacaaaaatgaaagccaccggtgaagtgatggcgattgaacggaatttagaagcagcaatacagaaggcagccgcgtcgcttgaattaaaaaatatcgggacacaccttccagagctcagcggcttgtcaattgatgcgctatgggagttggcagtcactccggatgaccgcagatttttcgttgtcatggagctgttgagccgcagcgtctcgattgatgacattcatgcgaaaacaaaaattgatccgtttttcctgtatacctttaacaacatcatcaaattggaaaaccgcctgatggaagagggcggcgatctctcttttgacttattgaaaaaagcaaaggaaaaggggttctcagacgcaacgattgcctcattgatcggcaaaacagaggaagaggtgcgcgcgcttcgcaaggagatgggcattacaccttccttcaaaattgtcgatacatgcgcggctgagtttgatgcgaaaacaaactatttttactccacatatttcggagagaccgatggagatatcagccgcaaagagaaaaaacgcgcgctgattatcggatcaggaccgattcggatcggccaaggcgttgaatttgattacagtgcggttcacggcgtgctgacactgcaagagcttgggttcgaaaccatcatgattaacaataacccagaaacggtcagcaccgattatgaaattgcggatcgcctgtattttgaaccgatgacaacggagcatattgtaaacgtggcggagcaggaaaatattgattttgcaattgtgcaattcggcggccaaactgcaatcaatgctgctgaagcgctcgaaaaagccggcattactcttcttggcacatcatttcaaacgctcgacgtgttagaggatcgggatcaattttatcagcttcttgacgagctgggattgaagcacgcaaaaggagaaattgcttatacaaaagaagaagccgcttcaaaagcgagtgagatcggctatccggtgttaatccgcccatcttacgttatcggcggaatgggcatgatcattgttgactcgcaagcccagctttctcagctgctgaatgatgaggacagcatgccatacccgattttgattgatcagtatgtgtctggaaaggaagtcgaaattgatatgatttccgacggcgaggatgtctttatcccgacatataccgagcatattgaacgggcaggtgtccattcaggggacagctttgccattcttcccggaccgtccatcacgagcgggctgcagcagggcatgaaagatgcggcacaaaaaattgcccgaaaactttcatttaaaggcatcatgaacattcaatttgtgatcgacaatggaaacatactcgttcttgaagtgaatccgagagcgagccgcacggtgcctgtcgtcagcaaagtaatgggcgttccgatgattccgctcgccacacgactgctggcgggagcgtccttaaaagatctaaatccggaagttcaaaatcatcatggagttgccgtgaagttccctgttttttcttctcatgcaatccaggatgtggatgtcaagcttgggccggaaatgaaatcaacgggagaaggcatgtgtgtcgcatatgattctaacagcgccttgaaaaaaatctatacaagagtctggagtcaaaaaggaagcatttatttgcaaaacgttccggaagaagtgaaggagttagcagaaaacgcaggttttacaattcatgaagggacatttgcctcatggatggaacaggaaggaaaatcgctccacatcaatctgagcggttctgaagaagcacgcaaagaacgtttggaagccatgacgcacggcatccccgtctttacagaagaagaaactgtgcgggcgtttttacaaagcggttcaggccatccgcagcctgtatctctcaaagacctctataaaaaggaagtggcatcatgcacacagtgacgcaaaccagtttatacggaaaagatttattaacgttaaaggaccttagtgaagaggatataaacgccttgctcgcagaagccggtgagctgaaacaaaacaaaattcagcctatattccatggcaaaaccttggcgatgatttttgaaaaatcatcaacgcggacccgtgtttcatttgaagcgggcatggcgcagctgggcgggaacgccctctttctaagccagaaagatctgcagctggggcgcggtgagactgtcgctgatacggcaaaagtgctgtcaggctatgtggatgccatcatgatccggacctttgaacatgaaaaggtggaggaacttgccaaagaagctgacattccggtgatcaatggacttaccgataaataccacccatgccaggcgctggcggatctcttgacgattaaggagataaaagggaagcttaaaggcgtaaaagtcgcatacatcggtgacggaaataacgtggcgcactccttgatgatcggctgcgcgaaaatgggctgtgatatctcgatcgcttcgccaaagggatatgaagtgttagatgaagcagctgaagcggcaaaaacatatgcacttcaatccggctcttctatcacgctgacagatgatccgattgaagctgtaaaagacgcggatgtgatttattctgatgtgtttacaagcatggggcaggaagcggaagagcaagaacgtcttgctgtctttgcgccttatcaggtgaatggggcgctagtcagccatgccaagcctgactatacatttttacattgtctccctgcgcatcgtgaggaagaagtgactgcggagattattgacgggccgaactctgcagtgttccagcaggcggaaaaccgtcttcatgtgcaaaaagcactgctgaaggccattttatataaaggggaatcatcaaaaaactgctgagccaaactcagcagtttttttgatggcaacatattcacagccgcttaggcgcatactacagcaaaaaggaaaaggaggaaaaacagtgggacagcagcaccaattccggcccggacagaaagcgcctaataacggtgtctacgtagaaatcggcgagacagggagcatggttaaaaaccctcaaaaggtccatctgtcagcaggggaaatgttccccgaaacatcaaaccacaaccggctgtggacctacaaaagaaagccgtgaccactaaaaaacccaaaacaataaatgttttgggtttttggctttttaatgctggcttgcatttttgttcataggcatgatttctgctaaaaccatgattaagacatacagtacaacagcaatgacagatgatgttttgaaattatacgtaacgctgttcatgcttgcaaccaagtagcatgccatatgtgataaaaggaacgtccaaataaaggcaataatatatcgcacgtttccacctcgtccttctcattctattctaaaagttatcataccatacaaaaagcgaagggggaatccaattttagcagaaagtgaggtgacaaaagagtctgattcgtcacactttaatggtaaaatataaaacgtcaatcagtataatagccaaaaatgtaaaaggctaggactttaccttattcgtttcttttctatttacataagatagcgtgagatgaagtgtgaaaggaggcgggcaagcgatgggaataacggaaagatactttcaactgggaacggagcataatgtcattcatctgccctatcgcccgaacggcttcggcatctttatcttgggggacagaacccactttgtcggacatgattcaagcttttggcagcagcattatggcagaaatcagcttctgagcatgttgatgaatgaaggatacactctttttaacagcaatctgttcggaaggcattggggggcggaaaaagcagtcacctatgccaaacagctgatacattctgtactgaagcaggaaatcctcaatccgaagattcatattttagcagaaggcatgggtgctctcgtggccgatgaactgcttcgtttttccccggatcatatccgctcagccgcaatgttgaatccttgtctcgatcttcaggcacattatgaatcggaaaaagaaaataaatttttctataaacaatttttgaaagaagtatcgaaaagctacggaatttctgaaaaagaagcggaagcgcttcgttataaaacaattcaaagctacccgagcggcgtaccggttcatatatggcagcgtatgaccggatctccatatccctacagtgtacatgcagaagttttcaaggaaaaacagcaaaagcaaggctcaccggtcgacatgacatttcatttatttgagcatccaagcagaatttatgcatcaatttgcaaattctttcacagtcatgaaaaagaattatagagaatataatgacaacagccttctcttttgcggaggctgttttgttttgggaaatgaaaaaccggaagggcggcagatgcaatggaatcaacgctgattgtaggtgcggacgaatttttcggcctttcattatgtgagcgaatgatggatgaaggcatacatgttgacgttgttctggcggaaacagaagataaaatgagacaaatgtacttagaagaaagactcatgtggcttgggagaaatgaactctttcgccagcttgaacacattggagaccaaaattatgatacaatttgtatccagttcggaagttttttgcctttagaccaatgtgattctccttatattttagtatatgaagaagaccgaaaagaatgggaaaaacgtgaaaaaacaggctcggaaaaaaccgtgatcctgccgaaaatgtatgggccatggaaagaagaaacagaggaagacggctattatacaaatgacgtcgctgacgagttgctgagattcctgttagaaccaagccgtcatagcaaagatcagctttttgaattgcaagtcacagaaaaaacctcaaaagaagaagcaaaaacaaaaattatcgagtggaaaagacaattttcatcaattttcgacaaatattaagaaaaaccttccatgtttcgagttttctagatacaataaacgtataaaaataaacatgttatagcttgtcaaaaggagttgaacatgacttgatcacaaggcttgtcatgatcttttctgtcctccttttattgagtggatgtggacaaactccgttcaaaggaaaaattgagaaggtcggcatgctctttcctgatacgattaatgacctcgtatggggcacaaaagggtataaaggattactgaatatacaatccaaatacaatgtggacgtctattataaagaaggcgttaaaacagaagaagatatcataaatgcgattgaggattttcataagaggggcgtcaatctgctctacggccatgggagtgaatatgccgaggtgtttaacttggtcggcgaagattatccagatatggaattcgtcatttccaatgcgaaagcgaaagctgataatgtaacaagtgtccattttagcggggaagcaatgggcttttttggaggaatgactgctgcccatatgtcgaaaacgaatcaggtcggtgtaattgcttcctttacgtggcagcctgaggttgacggttttatcaaaggggccaagtatgaaaatccggatatagaggtaaatacgaaatatacggatcattgggatgatgatacaacagcagtaaagctttatcagaaaatgaagaacgaaggcgcggatgttgtgtatcccgccggagacgggtataatgttcctgttattcagcaaatcaaaaaagacggtctttatgccattggctacgtcacagatcaatcggatctgggcgagaataccgtattaaccagcacggtgcaaaatgtggacaaggcctatgaaatcattgctgaacaatttaataaaggcacccttgagggcggcgatcattactacgacctgaatacgggagtcgttgagatgggaacattcagcccgctcgtcgacaaagactttcagcaaagaatcgccaagctgatcaaaacatacaacaaaacaggcgagctgccaaaaaacgagtaatggagtgacgtcacatgcagcacgaaaaatcacttgaattcttgcaaattgccatgaaatatctccctgaagcgaaagaacagcttgagaaatcaggcattgagctctcaatggaggccatccagccgtttatgaatctatttacaacggtaatggcggaagcttatgagcttggcaagtctgacgctaaatctgaaacagaataagaagaagccacttttttgaaagtggcttttcacatgattttctttttaatagcggagagcatgggcgcaagctcctttaaagcgggcttgatttgatcaagagagttcataattgaaccgatttggtccataatatgcatgtaattaatcgtctcttcgtcgtttgtctgagaaacctgagaaacttcctcttgttgttcctcctccttctcttctgttggttttgctgcatcgccgaacatcattcttgaaaacacatccaactgcatacgcctcctttccatataccatactctatgagtaagatgaactgatagtttagacgaatatattgccatgtgaaaaaaaataggatagaattagtacctgatactaataattgatcacaacctgattgatcttctaaatttaagatataaaggagtcttcccttatgaaagctggaatacttggtgttggacgttacattcctgagaaggttttaacaaatcatgatcttgaaaaaatggttgaaacttctgacgagtggattcgtacaagaacaggaatagaagaaagaagaatcgcagcagatgatgtgttttcatcacatatggctgttgcagcagcgaaaaatgcgctggaacaagctgaagtggctgctgaggatctggatatgatcttggttgcaactgttacacctgatcagtcatttcctacggtctcttgtatgattcaagaacagctcggcgcgaagaaagcgtgtgctatggatatcagcgcggcttgtgcgggcttcatgtacggggttgtaaccggtaaacaatttattgaatccggaacctacaagcatgttctagttgtcggtgtagagaagctctcaagcattaccgactgggaagaccgcaatacagccgttctgtttggagacggagcaggcgctgcggtagtcgggccagtcagtgatgacagaggaatcctttcatttgaactaggagccgacggcacaggcggtcagcacttgtatctgaatgaaaaacgacatacaatcatgaatggacgagaagttttcaaatttgcagtccgccaaatgggagaatcatgcgtaaatgtcattgaaaaagccggactttcaaaagaggatgtcgactttttgattccgcatcaggcgaacatccgtatcatggaagctgctcgcgagcgtttagagcttcctgtcgaaaagatgtctaaaactgttcataaatatggaaatacttctgccgcatccattccgatctctcttgtagaagaattggaagccggtaaaatcaaagacggcgatgtggtcgttatggtagggttcggcggaggactaacatggggcgccattgcaatccgctggggccgataaaaaaaggtgaggtgcacacaagatgactaaaaaaagagtagttgttacaggacttggagcattatctccacttggcaacgacgtcgatacaagttggaataacgcaatcaacggtgtgtccggaatcggtccgatcactcgtgttgacgctgaagaatatccggcaaaagttgccgctgaattaaaagaatttaatgttgaagattatatggataaaaaagaagccagaaaaatggaccgctttacacaatatgcggttgtggctgcaaaaatggcggttgaagatgcagagcttaacattaccgatgagatcgcgccgagagtcggtgtttgggtaggctccggtatcggaggacttgaaacactagagtctcaatttgaaatcttcttaacaaaaggcccaagacgggtaagcccgtttttcgtgccaatgatgattcctgacatggcgacaggccagatttctattgcattaggagcaaaaggggtgaattcttgtacggttacagcatgtgctacaggaacgaactccatcggtgacgcgtttaaggttattcagcgcggtgatgcagacgtgatggtcacaggcggaacagaagcgccgctgacaagaatgtcattcgccggctttagtgccaataaagcgctgtctactaatccagatccgaaaacagcgagccgcccgtttgataaaaaccgtgatggctttgtcatgggggaaggtgcagggattatcgttcttgaagaacttgagcatgccctggcccgcggcgctaaaatttacggagaaattgtcggctacggctcaaccggagacgcttatcatatcacagcgccggcccaagacggtgaaggcggagcgagagcgatgcaagaagccattaaagatgcaggcattgcacctgaagaaattgattacatcaatgctcacgggacaagcacgtattacaacgacaaatacgaaacaatggcgattaagaccgtttttggcgagcatgcgcataaacttgcggtaagctctacaaaatcgatgacaggccacctcttaggagcagccggcggtattgaagccattttctctatcctggccattaaagaaggcgtgattccgccgacaatcaatattcaaacacctgacgaagaatgtgatttggattatgtgcctgatgaagcccgcagacaggaacttaattatgttctcagcaactcattaggattcggcggacacaacgcaacattaatctttaaaaaatatcaatcataatcaagccaaaccggctgcccttaaagggtagccggttttttttgtgtgcataggattaaaagaggaggcgatcacatgagtgtagaacaaacatatagctggctcaggaaggccggttcaatagatgatttggcgcattacattatcccgcttttttcaggtgcggagaaaaagaactggaagggcattctggggcatcttcagcatcatgggatgtttaaaaacataaaagagggtattcagacggtttccaagctgaaggaaaaaggtttttacggacatatccaaaaggaagaacagtacctcaaaaacaaatggcaaggtcctgatgtaccaattgttacgctgccggttgatgaacgaaacaggagaatccgtttagaattcggatcaaaatcaggactcgcctttcaagacaaaatgttcctttttctttcgtcagatttagattttgggtcggtatctgcccttatgacgcatgagtatcatcacgtttgccggttaggtcatctgacaaaagaggaaaaggatgtcacattacttgatacaatcatcatggaagggctggcggaatatgctgtttatgagaggttcggccgaagtcaaacggctgaatggacgacttggtatacaccggaacagcttcaggctttatatgaaaaaaagattgcgccccatcgggatatcaaacgggataatcgattatttccccagctgttattcggcaaaggatatcagccaaaaatgcttggatacgcagttggattcaatattgtaaaaaaatatttaaccgccagcaaggcaagcaccgcagacgggctgtccattcctgctgagacctttttggatgcaatgctttaaaaggataaaataatggaatttcattaataatattacatttatcctaaaaaattcttgattttgcaaaatgattgtaataatatacaactataaaatttttcgataattcaatattatttattatttctgaataaagggattgctttctcttgaaaacgtttgacaacaagaggggggaaaggggagctagcatgagcacacttttagaagtgaataatttaaagacttattttttcaggaaaaaggagccgatccctgcggttgacggagtcgattttcacatcagcaaaggcgaaaccgtcgcgcttgtaggtgaatcgggctccggaaaaagcattacttctttatcaattatgggcctcgtccaaagctcaggcggaaaaatcatggacggctctattaaactcgaagacaaagacctcacctcattcactgaaaacgattattgcaaaatccgcggtaacgaagtatccatgatctttcaggaaccaatgacctcccttaatccggtgttaacaatcggagaacaaattaccgaagtgctgatttaccataaaaacatgaagaaaaaagaagcccgtcaacgagctgttgaactcttgcagatggtcggtttctcccgggcggagcaaattatgaaggagtacccgcatcggctgtccggcggtatgagacagagggtgatgattgccatcgcactgagctgtaatcctaaactgctcattgctgatgaaccaacgacagcgctggacgtgacaatacaagcccaggtgctggagctcatgaaagatctctgtcagaagttcaatacatcgattcttctcatcacacacgacttaggtgtcgtgtctgaagctgccgatagagtgattgtcatgtactgcggacaagtcgtagaaaacgccactgttgatgacttatttttagaaccgcttcatccgtatacagaaggcctgcttacgtcaattcctgttatagatggagagattgataaattaaatgcgattaaaggcagtgtgcctacaccggataatctgccgccggggtgccgttttgccccaaggtgcccgaaagctatggataagtgctggacaaatcagccttcgcttttgacacacaaaagcggaagaacggtgagatgctttttatatgaggaagagggtgccgaacaatcatgacagcagctaatcaagaaacaatcttagagcttcgtgacgtaaaaaaatactttccgatccggtcaggcctttttcaaagaaaagtcggtgatgtaaaagcggtggatggtgtttcattttcgttaaaaaaaggagaaacactcggaatcgttggagagtcgggctgcggaaaatcgactgccggcagaacgatgatcagactgtacaaaccgacagagggccaaattctttttaaagggcaggatatttccaatctgtcagaggagaagctgcggaagagtgtccgcaaaaatattcaaatggttttccaagatccatttgcttcgttaaacccgagaaagaccctgcgttccatcataaaggagccgtttaatacgcacaacatgtataccatgcgtgaacgaaacgaaaaagttgaagagctgcttgcaagagtagggcttcacccgtcgtttgccggccgttatccccatgagttttcaggcggccagcgtcagcggatcggcattgccagagcactcactttgaatccagagctgatcattgcagatgagccggtttccgcacttgatgtatccattcaggcccaagtgattaacttgatggaggaattacaggaagaatttaatcttacgtatctatttatctctcatgatctgagtgtcgtccgccatatcagcgacagagtcggagtaatgtatcttggcaaaatgatggaactgaccggcaagcatgagctttatgacaacccgcttcacccatatacccaagcgcttttatcctccgttccggttacaagaaaaagaggttctgtcaaacgtgaacgcattgtcctgaagggagaactgcctagtccggccaacccgccaaaaggctgcgtattccacacaagatgtcctgttgcaaaaccgatatgcaaggaacaaataccagaatttaaagaagctgctcccagccactttgtggcttgtcacctttatagctaatgttgcccgcacagctttgagagggggtatgcacactacataaacaacagcctagaagaacgaacatttcaagagggggaatatctaatgaaaagacggaaaaccgcactgatgatgctaagtgtattgatggttctggccatctttttatcagcctgctcgggatcaaaatcaagcaacagcagcgcgaaaaaatcagcaggcaaaccgcagcaaggcggggatttggttgttggttcaatcggagcgccaacacttttcaactcattatattcaacagatgaatcaagtacagatattgaacaaatgatttacagctttttaacgaaaaccgatgaaaacttaaatgtcaaaatgtcactggcggaaagtgtgaaagagctggatggcggattgaaatatgacgtaaaaatcaaaaaaggcgttaagttccatgacggagaagagcttactgccgatgatgtcgtctttacgtacagcattccgcttaacaaggattacaaaggagagcgcggctctaactttgaaatgctgaaatcagtagagaaaaagggagattatgaggttttatttacgctgaaatacaaagaccctaacttctataacaatacgttagacagctacgggattctgcctgagcacattttaaaagatgtaccggttgcagagcttgaagataacgaatttaatagaaaaaatccaatcggctcggggcctttcaaatttaaagaatggaaagacggacaatacgtgaagcttgttgctaatgatgactactatgacggccgtccgtatttagacagtgtcacgtataaaatcattcctgacgccaatgcagcagttgcccagcttcaggccggagatattgatttctttaacgtgccgtcaactgactataagacagctgaatcgtttaataatgtcaaagtcgtaacagatttagcgttaagctatacgtatatcggttggaatgagaaaaatgagctgtttaaagacaaaaaagtgcgccaggcgcttacgacagctttagaccgtgaaacaatggtgcaaaccgtattagatggggacgggaaggtcgcttatatccctgaaagcccggtttcatggaactatccgaaagatatagaggttcctaaatttgaatacaacgtcaaaaaagctaagaagatgctgaaagaagccggctgggaagatactgacggtgacggcatcctcgataaagacggtaaaaaattcgagtttacactgaaaacgaatcaaggaaataaagttcgtgaagacattgcagttgttgttcaagaacaattgaagaaagtcgggattaaggtaacgccgcaaatcgttgagtggagtgcattagtagaacagacaaatccacctaattgggactatgacgcaatggttttaggatggagtttatcaacgttcccagaccattacgatatcttccattctagccagtctgaaaaaggcttaaataacatgtggtacaaaaaccctgaagttgataagcttctcaaagatgcaaaatcaatcagtgaccgtaacgaatactcaaaagcttacgaaaagatttaccaaaaacttgctgaagatcagccgtataccttcctttactatccgaacaaccatatggcgatgccggctaacttagagggttatgtgtatcatccaaaacgcgagttgtaccaaattgaaaaatggtggcttgcccaataatttataattttcccttgcaggggagggagtgcgtttccttcccctttgaatttgaaaaagaacaacgaaggggacaagaatatggttacatatattattcgaagaacgttatcttcgattcctattcttttgggaattacaattttgtctttcattattatgaaagccgctccaggggacccgatgacacttatgatggatcctacgatcagccaggcagacagggctcagtttattgaaaagtacggtctcaatgaccctgagtatgttcaatatttaaaatggctgggcaatatggttcaaggcgatttcggcacatccatcatcagaaaagggacgcctgtttcagaactgattttagcacggctgcccaacacactcctcttgatgctggtgtcaacaattttggcgctgatcatttccatcccattcggggtaatttctgcaaaaaaaccttattcgaagctggactacggcattacatttacttcatttatcggtttggcaatcccgaatttttggttcggtttgattttaatcatggtgtttgccgtgaatctcggctggtttccaaccgggggagtcgccacccttaactcagatttcagtatagtagaccggattcatcatttgcttttacccgcttttgtgctggcgacagctgatatggcaggcttaacgagatatacaagatccaatatgcttgatgttttaaatcaagattatatccggactgctagatcaaaaggtttcaaagagaatcgagtattatttaagcacggcttgcggaatgcactattgcctgttattacgattttcggcttaatgattccttcctttattggcggagcggttgtcgtagagcagattttcacttggccgggattaggaaagctgtttgtcgattcagcattccagcgcgattatccggttatcatggcaatgactgtgatctcggcggttcttgtcgttgtcggaaacctcattgcagacatcctttacgcgattgttgatccgcggatcgaatattaaaaggagggaaacagagatgtcagagctgcaaacaactccctcgccggagatcaggctgaaagaaaatatttcgaaaaagccagaaacaatgacaaagattttctgggaaaaattctcgaaaaacaaactggccattttaggtgccgttattctttttatcattattatgtctgctgttttcgcccctttaattgcaccttatccccaagagcagcaaagcctgcttgataaatataaggcgccgggccttgaacatctgatgggaacggataaatttggacgtgatattttcagccggatcctatatggagcgcgtgtctctttattggttggatttgcgtccgtagtcggttcgattttgatcggaacggttttaggagcattagccggatatttcagaggaatagtggatgctgtcattatgcgtgtagttgacattgtgttatccattcctgatattttcttgttgatcacgctggtcaccatcttcaagccgggtgtggacaaactgattttaattttctgtctcacaggatggaccacaacagcacgattagtaaggggagaattcttgtcgctccgttcaagggaatatgttcttgctgctaaaacaattggaacaaaaacgcacaaaattattttttctcatatcctgcccaatgcgttagggccgattatcgtgtcagctacgctgaaagtagggtctgttattctagctgaatcggcgctaagctacttgggctttggaatccagccgccaatcgctagctgggggaacatgcttcaagacgcacagaatttcacagtaatgattcaagcatggtggtacccgttatttcccgggctatttattttaatgaccgttttatgcttcaactttgtcggtgatggcctgcgggatgcgcttgacccgaaaaatattaaataaaaatgaatatcatatctgttataaaatatcaccaaatcagaaaaaaagcaggtctccttttgtcagaaaatatacaaagagatctgctttttatgattcttacataaacccactgattccagatttcctcaatctctttggaataatttctctatcccttgcctatactgtggacaacagtttttataaaagtgaggggttagagatgttatttcttcatgatgtgtgggtcaattggtttgaaggggaagaaaatggctacaatgtatgccactttcacgaatggcgcaaggaagatacggttgagcttttggatcaggtgccgctgttaagggtgccgtcagtactgtttcattacatagaaaacgatttgtcagagcttccgaaaggtttgcttgaagacgtacatcagaaatcgtacattcggaaaaatcatgagcggacaaagcttgagtattgttttgtcgtaacagacggaatcggcattttagctgtcgacacgatcggctacacgatccctgtcagaaaaagccgtctgatcccaagacaggagcagctcgtttatgaaatggtaaaagatgtagagcctgaaacatatgaatttgagccaaagaagctggaatcctccaaggaatatcacatcttatcattagcaccagaacatgtcagaggactgacaagaaaagaacggcaaatcaagcagctgatgtttatggcgcttgaccaattaaaagggctgaaaaaccgggcggaaattggttactggtacacagagtggaatccgcatatgtatgaacaaatcaaaaggatgagctttgaagagatttgggacatgctgtataacgaaacaattgaaggctggtcggacaagcacctagctttttgcgaaaacctaataaaaggacagccttttttcgaaaagctttgggaaatggaaaacgaatcaaaggtcaactgaaaaaaaccgctctttgcaaagagcggttttttgattagcgtctttttcttccaagacccatggcattctccatttttttcagcattttgtttgctgtccggttcgcccgttccgcgccttcatcaagaatccggtctaattcttcagattctatcagctcataatagcggtcctggatcggttttaatgcgttcaccacgacttctgccaaatcacctttaaactcgccgtagccttttccttcgtactttgcttcaagctcttcaattgtcgtattgccgaggattgaataaattgtaagaaggttggaaacgcccggtttgttttccttatcaaatttgacaatgccttcagaatccgttacagcgcttttgattttcttttcaagctgcttcggctcatccagcagggtaatataagctttctggttcggatcagatttgctcatcttcttcagcggatcattcagagacatgatgcgtgcaccgacttttggaattttcacttccggaatcgtgaagatgtcgttgtattttttgttgaagcgttctgcgagattccgcgtcagctcaaggtgctgcttttgatcctcaccgacaggcacgagatccgttccgtacagcagaatatcagcggccattagcggcggatatgttaacaggccggagacgacagcttcattgcctttggatttgtccttaaattgagtcatccgctcaagctcgccgatatatgcgacacactgcatcatccatccggcctgcgcatgcgcggggacctctgactgaataaacaatgttgctttttctggatcaagtccgacagctaagtaaagcgctgcgagattgcggatattctttctaagctcaagccggtcttgaggaacagttatcgcatgctggtccacgatgcaaaaatagctgttataatcatgctgcagttcgacaaactgcttcattgcaccgatatagttgccgagcgtcactgagccgcttggctgaatgcctgaaaaaatcgtttgtttcatgaaaacatcaacctcatttcttaaaacataataaaaaaggctcattcttcccctgtaaaaaagggacgaatgaaccgtggtaccaccctgattattccattaaaatgaaatcactctgacgtttgtaacggagactgctccggctgagcctacttttttccagttcggtcagctgctccaaagtccattccacattgcccgttatctgctcccagcaccgcagactctcttcaaacaggtgaaatgtgtactactctttttcatagcaagcttttcttttgattgcttcattataaatcaattataaccaattgtcatcatgaaaaaacattcttttttccagtaaaattgtaataatataaataacacgagtgttgtaaaatccttaaatgataactgctatcagcgtaaaaacaggcagatattatatgtaaaaagcaatatgggcagaagacacatgaaaaagtttttaatcaatttatgctttaaatggtagaaggatattatgttcatggaagaaaaactaacgaagtttaaatattttaaattgataaaataatattgcaataaattatttgtttcattataatgaacttgttcactctattgttacagcttttttacaaaaataatcagaaaagacggaacagaataaaagtttgtgaaaactcaggttcatttgtctgatatttctgaggatttagccgtaaggagctgaaaattattattagggggtttgcgaatatgaaaaaacgttggtcgattgtcacgttgatgctcattttcactctcgtgctgagcgcgtgcggctttggcggcagcggatcaaacggtgaagggaaaaaggacagtaaaggaaagacgacacttaacattaatattaaaactgagccgttctccttacatccgggattggcaaatgattcagtttcaggcggtgtcatccgtcagacttttgaaggattgacacgcatcaatgcagatggggagcctgaagaaggcatggcatccaaaatcgaaacaagcaaggacggtaaaacatatacattcactattcgtgatggtgtgaaatggtctaatggagaccctgtaacagcacaagattttgaatatgcttggaaatgggcgcttgaccctaataatgaatcacaatacgcttaccagctctactacataaaaggtgctgaagcggcgaataccggaaaaggcagcctagacgatgtggcagtaaaagctgtgaatgacaaaacgctgaaggttgaattaaataacccgacgccatatttcactgaattaactgcgttctatacgtatatgccgatcaataagaaaattgcagagaaaaataaaaagtggaatacaaatgccggagatgattatgtatcaaacgggccgttcaaaatgacggcatggaaacacagcggttctattactctcgaaaaaaatgaccagtattgggataaagacaaagtcaaactgaagaaaatcgatatggttatgatcaacaataacaatacggaactaaaaaaattccaagctggcgaacttgattgggccggtttgccgctcgggcagcttccgacagaatctctcccttccttgaaaaaagacggttctttacatgttgagccgatggcaggtgtgtattggtacaaattcaacactgaagctaagccgttagacaacgtcaatatccgtaaagcattatcttatgcgattgaccgtcaatcgattgttaaaaacattacgcaaggtgaacaaatcccggctatggctgcggtgccgccgacaatgaagggatttgaggataacaaagaaggctactacaaagacaacgatgttaaaacggcaaaagaataccttgaaaaaggcctaaaagaaatgggcttaagcaaggcatctgaccttccgaaaatcaaattgtcttataacactgatgatgcacatgcgaaaatcgctcaagctgtacaagaaatgtggaagaaaaatttaggcgttgatgttgagcttgataactcagaatggaatgtctatattgataagctccacagccaagattatcaaatcggccgtatgggctggcttggggacttcaatgatcctatcaacttcctagaattgttccgtgacaaagacggaggaaataacgatacaggctgggaaaacccagaattcaaaaaattgctgaatcagtcacaaactgaaacagatcaaaacaaacgtgcagagctgctgaaaaaagcggaaggtattttcattgatgaaatgccggtagctccaatttatttttatacgattccttgggtacaagacgaaaatctgaaaggaactattattactggaactggagaaatttacttcagaaacgcgtactttcaataagtcttatttgtgaaaacaataacctcaaggtatatggggacctatttcccatatacctttcttactgaggaatataaaaaagtaaaaaccatggaggtgttcccccttgctaaaatatatcggaagacgcttagtctatatgattatcacactatttgtgattgtaactgtgacattcttcttaatgcaagcagcaccgggcgggccattttcaggtgagaaaaagcttccgcctgaaattgaagcaaacttaaatacgcactatggcttggacaagccgctgtttgtacaatatgtcagttatttgaaatcagttgcaatgtgggatttcggaccgtcatttaaatataaaggtcagagtgttaacgacctgatcagttcaggtttccccgtttcatttactcttggagcagaagctattctcctcgctttagcattaggtgtattgtttggagtcattgcagctctttaccataataagtggcaggattataccgtcgcgattttaacgatatttggtatttcggttccgagctttatcatggcggctgttctgcaatatgtgttctccatgaagcttgggctgtttccggtcgcggggtgggattcctgggcatacacctttttgccttcaatcgcacttgcttccatgccgatggcgtttattgccagactttcccgttcaagcatgatcgaagtgttaaacagtgattatatccgcacagcgaaagcgaaagggctgtcccgcccagcggttacagtgcggcacgccattcgaaacgcgcttttgccggttgttacatatatgggcccgatggccgcacaggtcttaacggggagcttcattattgaaaccatttttggtatccccgggcttggtgcacacttcgtcaacagtattacaaaccgtgattatacggtcattatgggtgtaacggtgttcttcagtgtcatcctgctattgtgtgtattaattgtagatgtgttatacggcattattgatccaagaatcaagctttccaaagcaaagaaaggagcctaggccatgcagaacattccaaaaaacatgtttgaaccagccgcagcgaatgccggcgatgcagaaaaaataagtaaaaagagcctttccctctggaaagatgcgatgcttcgcttccgcagcaataagcttgcaatggtcgggcttatcattatcgtacttattatccttatggcaatttttgcgccgatgttctcaaggtatgattattcaactactaatctcttaaatgcggataagccgccttcaaaagatcactggttcggaacagatgatcttggacgggacattttcgtccgtacatgggtaggggcgcgtatctcaatctttatcggtgttgcagctgctgttctcgatttgctgatcggcgttatttgggggagcatttcaggcttccgcggaggcagaacggacgaaatcatgatgcgtatcgctgatatcctttgggcagttccttcattattaatggttatcttactgatggttgttcttccgaaaggtctatttacgattattattgccatgacgattacaggctggattaatatggccagaatcgtgcgcggacaagtgctgcagctgaagaatcaggagtatgtgcttgcttcacagacactgggtgcaaaaacatcccgtcttctgtttaaacatatcgtgccaaacgcaatgggttctattttggtcacgatgacactgacagttcctactgcaattttcacagaagcctttttaagttatttgggacttggtgttccggctccgctggcgagctggggaacgatggcttctgacggattgcctgcattgacctattatccgtggcgtttattcttccctgccggatttatctgcattacaatgtttggtttcaacgttgtcggcgacggattaagagacgcattggatcctaagttacgtaaataagggagtgatacgggtgacacgcctattagaagtaaaagatttagcaatttcatttaaaacatatggcggagaggtccaggcgatccgcggagtgaatttccatctggataaaggggagacgctggccattgttggagaatcaggttccggaaaaagtgtaacctctcaagcgattatgaagctgattccaatgcctccgggttatttcaaacgcggtgagatcctgtttgaaggaaaggatctggtgccgctgtccgaaaaagaaatgcaaaatgtccgaggaaaagagatcggcatgatatttcaggatccgatgacctccttaaatccaacgatgaaggtcggtaaacaaattacggaagtgctttttaaacacgaaaagatctcgaaggaagcggctaaaaaacgcgcggttgaactgctggaattagtcggtatcccaatgccggaaaagcgggtgaaccaatttccgcatgaattttcaggcgggatgagacagagggttgtcattgccatggcgcttgcagcgaatccgaaacttctgatcgccgatgagccgacaactgctcttgatgtaacgattcaagcgcaaattttggaattaatgaaggatttgcaaaagaaaattgacacgtccatcatctttatcacacacgatcttggtgttgtggctaacgttgctgaccgggtcgctgtcatgtacgcgggacagattgtagaaaccggtacggtagacgaaatcttctacgatccgagacatccgtacacttgggggcttcttgcatccatgccgacactggaaagttcaggagaggaagagctgactgcaattccgggcacgccgcctgatttgacaaacccgccaaaaggagatgcttttgccctgcggagctcttacgcgatgaaaatcgattttgaacaggagccgccaatgtttaaggtatccgatactcattatgtaaaatcgtggctgcttcatcctgacgcgccaaaggtagagccgcctgaagcggtaaaagcgaaaatgcgtaaactggcaaatacgtatgaaaaacctgtcttagtgagagaaggtgaatgaattgactgaaaaattattagaaatcaaacatttaaaacagcactttgtcacaccaaggggaacggtcaaggctgtagatgatttatcatttgatatctataaaggtgaaacattagggctggttggtgaatcaggctgcggtaaatcgacaacaggccgaagcattatccggctgtacgaagcaaccgatggtgaggtgctgttcaacggcgaaaatgtgcacgggagaaaatcgcggaaaaagctgctggaattcaaccgcaaaatgcagatgattttccaagacccatatgcatccctgaatccgagaatgacagttgctgatattattgctgaaggccttgatattcataagctggcgaaaacgaaaaaagagcggatgcagagggtccatgaactattggaaacagttggtttaaacaaggaacacgcgaaccgttatccgcatgaattttccggcggccagcgccaaagaatcgggattgccagagctcttgctgttgatccggaattcattatcgcggatgagccgatttccgctttggatgtatccattcaagcgcaggtcgtgaatttaatgaaagaactgcaaaaagaaaaagggctcacatatctgtttattgcccacgatttatcgatggtcaaatacatcagtgaccgcattggcgtcatgtatttcgggaaactggttgagcttgcgccggcagatgagctttatgaaaatccgcttcacccatatacaaaatcattgctttctgctattcctcttcctgatccggactatgagagaaatcgcgttcgccagaaatatgatccgtctgtccatcaattaaaggatggggaaacgatggaattccgtgaagtcaaaccgggacattttgtgatgtgcacggaagccgaatttaaagctttttcatgattcatcaatccttcaagagatttctcttgaagggtttttttgcgtcctcatagaaagtgagaatgataacatttacaattagaggaaaaaagcggaggcgaaatacgattcaatttctgcataacaaaaatgtttttgcgctattgctgtctcaatcttttcaatctttagcaggtgtcctcgtcacaatcgttttaatggtccgggtctatcaaatgactgactccgtttttttggcgggccttattttatcgttcatgtcgtttgcgagtatagcagcaagcttttgcgtctctccggtgcttcgcattctcggttttaaaaaggtgcttgcgggagcgaatctgctgagagcggtctttacaatcctgatggcatacagcgtcactcatcacggacaggcattcttttggattacgctgctgtttgtgttttgtttttccttcgcgggcgctttttttcagccggcaagatttgcgctgctgccgattattgttccaaagaagcaatatgtaaaagcgaatggtgtgatctccctctcgaatcaattgttcttaacagcaggctggggccttggaggccttctgacgtacgccgttccttttgaactcgttgtcggcgctgccatttgcctgtttgttctatcgggagcttccatcagtgtgttgcatgtaaatgaagaagaggctgcaggaactgctgaaacagcatctgtcagaagtatatggaaggatttaatgatcatccctattgtaagagacattactgtaatggacatgttagaagctttggcgggttccgtatggtcatctgctattctcctcgcatttactgcggctgttttgcatgaaacagaggtgtggtgggggatgtttaacgcttcctattttataggcgcaattgtcggcagtgtgattgctattcgtttttcttctttttttgagcggaatatgggctatgccattatgttcagctcgcttgtaatgtcggcgctgacccttttgttttcattttctccagtcccatttttatgcgctctggcttgtgctgcaatggggcctttttatcaggtgcgtgatatttgccaggaaaccatgctgcaggaggttattcccgagcagaaacgaatcggaatcatggctgcaaaaaatgcgattttgactccttggtcaggcgtcacctactccattatggggctagtggctgatgctgctggtgcgaaaatagcttttatcgcggctgctgcattatatatcatgacatttctgattgcactggcgcagccccgcctgattcattacaggcgggaaaaccgagttcaatgagatacacttcaaaatgaacggagcagctggctccgtttttgctgaaaaaaaatgaaaccatggcggaagttcgcacgtctttatagatgtaaggctgtttaaacaagaagaaatggggtatatctaaaagtatgaagacaacgaactcataaggagcaaatcaatgaactggtatgaaaagcttagcgagtactttccaattgaagaaatgaaatcaaaagcgcatatggaagctcttctgaaagagcgaagcgatatttatcataaagatgaaggcaaacatcatattttaatgtttgcggagttcgattcttttatcttcgttgattatctgtatgtgtctaaggatgcaagagggcaggggcttggcggcaaattgatcgcgaagctgaaaaagaaaaataagcccatattgctcgaggtggaacctgtggatgaagatgatactgatacagaaaaacgcctgaggttttatcaaagagagcatttcaagcatgctcagtcaattgggtaccggcgccggtcattggctacgaatgaagtaaacaagatggagattctgtactggtcaccaaaaacagaatcagaagaagaaattcttgaagccatgaaacagacatatgaaaacattcatacttataaagacgagaaatggtacggagaatcgtacgaaaaaacggatgaagtcctgaaactcattgatgaagaaaaacaaaaaaatattttcgatcagttaagctaattgagaattagaacatatcatgaacattaaaaatttgctggattgacacatttttttcttaggatactgttcacacttacttttttatagtataatacctgtaaagattccttttttagagtaatttcaatttaagaataaaatagatgttcatcctactaattagaggagtgaagatgaatggttacactatacacatcaccaagctgtacttcatgcagaaaggcgagagcgtggctcgaggagcacgatattccatttgtagaaagaaacattttctctgaacctttatcaattgatgaaataaaacaaattcttcgaatgactgaggatggaacagatgaaatcatctcaacccgttcaaaagtattccaaaaactgaatgtgaacgttgaatctatgccgctgcaagatttgtaccgcttgatcaacgagcatccagggttgcttcgccgtccgatcatcattgacgaaaaacgtttgcaggtcggatataacgaagacgaaatcagacgtttcctgccaagaaaagttcgctctttccaattaagagaagcacagcgtttggcaaactaatagatcgtatcatcaaaagaaggctgagtcatcagccttcttttatttttcaacctgctggtaataaatgctcgcaagaatgacaaacgcaaccgtcaaaatggggaggagcgtttcaactgtgccgtgctgcgccataaaaagagacagctttttgtctctgacaatcatttctccgccagtataagcaagcagcccgcttcccgcgtaaatcagaagcggtattttctctagtgcaatatggatgagtttgctgccccaaataataaccggaaccgatacacacaaacctataacaacgagagaaaactcaccgtgtgatgctcccgcaactgcgatgacgttgtccagcgacataaagagatctgcaagcacaatcgttcgtatcgctctccacagggaggtgctgcttttaatgtgcttcgtgtcttttttttcaatcagcagctgatatcctaaatacagcaggaaaattccgccggcgcactgcaagaacggaatgttcaaaagatatacagctgcacttgttaatccgattctcatggcaacggcaataaatgttccgagaataatggcttgctgtctttgcttgtccggcaaatgtctgctggccatggcaataacaaccgcgttgtctccgccgaggatcaggtcaatcccaacaatgacaagcagagaaatcagatagtcatgctccatgaagcggcacctcgctttcagtccttcgcttgtactactactatatgagacaggttgtattttatgatatcagccgcctgaactgccgttttttaggaaaaggtgcatttttatttcttttgtgactgttttatcataaaatagaaatacaaaggaattcacactggccttggttaaggttaagatgtggacggaatgggtaaagtgtagtaaagtacaattaatcgggagcttagatgtcccttcaacatcttatatagaagggaaggttggcaaatggaaattgaaagaattaacgagcatacagtaaaattttatatgtcttacggagatattgaagatcgcggttttgacagagaagaaatttggtataaccgtgagcgcagtgaagaacttttctgggaagtcatggatgaagttcatgaagaagaggaattcgctgtggaaggcccactttggattcaagttcaggcactggacaaaggattagaaatcatcgtcacaaaagcccagctttccaaagacggacaaaagctcgaactgccgattcctgaggataaaaagcaagaaccagcatctgaggatcttgacgccttgctggatgatttccagaaagaagagcaagccgtcaatcaggaagagaaggagcaaaagcttcaatttgtcttgcgatttggcgattttgaggatgttatttctctatctaatttgaacgttaacggaagcaaaacgactttatattcgtttgagaaccgatattatttatatgtagatttttgcaatatgactgatgaagaggttgaaaatcagctaagcatcctgctggagtacgcaaatgaatcctcaatcagcatacaccgtcttgaagagtacggcaagctgattatttcagagcatgctctagaaacgataaaaaaacactttgcatcatagcaaaccgatttccttccggaaatcggttttttttatgcacgaaaatgccattttagagatgtgaaaaatcaaaaacatatagacaagcggaaaatacagcgaacaggagttgatcatcttttccagaaagtatacttcatctggaaaggagagatgacaattgtttagtgctgtgactgaagacggccaaatgtttcaccttctaggcgctcagcaaaaccagaaattaaagcggagacggttcttctgtccggtatgcgggggagagctagctgtgaagctcggacttcaaaaagcgccgcattttgcccataaacagaacaagtcctgctccatagatatcgaaccggaaagcgcctaccacttagaaggaaaaagacagttgtatgtatggctgaaaacgcaacgggcttcaccaatattggagccgtatataaagacaatcaaccaaagaccagacgtcatggcaaggatcaaggagcatatgcttgctgttgaatatcaatgcgccactatcgctccagatgtctttcaaaagcggacagagggcttcaaacaagaaggaatcatcccgcagtggattatgggatacagccgcttaaaacggactgcttcgtccttttatcagctttcagcttttcattggcagtttatcaatgcaagtccatacagagaactgatatgttattgtcctgaaaggcgttcttttctccgactcagccacatcattccattctacacaaaccattcttattcctcagtccaaacgatccctatccatcgggcaggtgcagacgatctttttttcactgaaccgaaaccctcaattcaatattcaggctggacgaaagcgattcaccgttttcgccataaaccccatcggtttaactctaaggaaacaaatcgccttaggcagatgttttatgagaagcggcagacatctttttcttttctgccgactgaagtgtttgttcctgttagaaaaggggcagtttttaagagtccggtttttgtgtggcaggggtttctttatttgtttatgacggatcttggagataaacgtgcgccaattcgtttttcagctgttttgcagcagtgcaaactgcacattcataaaaagaacattgcactcaggttcgaatgcagcgaagagtgtctttcagaagcggttaaacagtatattgattttttgtgcaagaagggatttttaagggagactcagaaagaagtatatgtgctgaatcggcctgcaggcggcatacattcaatgcaggatctcatagaaagagaccgcagctgttttatagaatgagtttgtctgatttggctcaccctaagacaaaggtggtgggcaggctgtgaaaggcacaaaaggaaaggtttttcgtgtttttactgcttttttggcattcgttctcttcattactgcatatgatttgacaaaaggcagtgaaaaaccggaagatattcacaacacaagtttattgagaaacagctgttttttcaattggcttgaatcaaagaagacgagggggatcaccatggctgaggaaaaaaaagcaaaccaactgcctgacagaagtgaggtaaaggcagaagacacatggagacttgaggatatttttcctagtgatgaggcctggaataaagaatttcaagctgtaaaagaattaattccgaatttatctaagtataaaggaaagctggcagattcagctgatcatttatacgaggctcttacgtatcaagataaagtgatggagcggctgggtaggctgtacacatatgcgcatatgcgctctgaccaggatactgggaactccttttaccaggggctgaatgacaaggcgggaaacctgtatacacaggccgcaagcgcgacagcttatttggttccggagattttatccatagaagaagacaaactgcagcagttcattcttgaaaaagaagaattgaagctgtactctcatgcgattgaggagattacaaaggaacgtccgcatgtgctgagcgagaaggaagaggcactgcttgctgaagcctccgaggtactggggtcatcttcaaatacattcagcgtgttaaataacgcagatataacgtttccgtccattaaagacgaagatgggaatgaaaaacagatcactcacggcaactttattaatttcttggaaagtgaaaaccgtgaagttcgcaaaaatgcgtttgacgcagtgtataaaacgtacggacaatataaaaacacaatggccacgacgctaagcggcactgtgaaaaaggacaacttctacgcgagagtgaaaaagtacaagtcagcgcgtgaggctgcgctttctaacaacagtattcctgaggaagtatacgataaccttgttaagacgattaataagcatttgccgctcctgcaccgctatattgcgctaagaaagaaagtgcttgagcttgatgaagtgcatatctatgacctgtatacaccgcttgtgaaagatgcggggatgaaggtgacatacgaggaagccaaagattacatgctgaaaggcctcgcacctttaggggaagaatatgcctctatcctaaaagaaggactggaaaaccgctgggtggacgtttacgaaaataaaggcaaacgcaatggggcttattcatcaggagcttacggcacgaatccgtatattttgatgaactggcataataacgtcaataatctctttacgctcgtgcacgagtttggacattccgtacacagctactatacgagaaagcaccagccttatccatatggcaattacagtatctttgtcgcggaagttgcctctacgacaaatgaagcgctccttggcgaatatttgctgaacaatttagaggatgaaaaacagcgcttatatattctcaaccatatgcttgagggcttcaggggaacggtcttcagacaaacgatgttcgctgaatttgaacatctgatccatacaaaggcgcaagaaggcgagccgcttacacctgagcttctgacaaatgtctattacgacctgaataaaaagtattttggagacggcatggtgattgataaggaaatcggccttgaatggtcgcgtattccgcacttctattacaattactatgtgtatcagtatgcgacagggtacagcgctgcccaagcattaagcagccagattttgaaggaaggaaagccggcggttgaccgttatattgacttcctgaaagcgggaagttcacaatacccgattgatgtcttgaaaaaagcgggtgttgatatgacgtctccagagccaatcgaagccgcgtgcaaaatgtttgaagaaaaacttgatgaaatggaagagctgctgatgaaagtcaagcagtcttaaaaagtaagcctgtgcggaaatgacgcacaggcttttttaaaaccctttaaaggttttccggtgattcaagcggtagagggtaaacaaaatagacagaaacagcagaggagaggtaatataaagcggcagcatatgcatcatgcctaagatattcagacagaaaaaaacggcaatgcacacaattgagatcaaagtagacatcatggcgatcctcctcgtcctttttccttataaggatatgagtgaatgcacttcgttatgttttgtgacaaaaatatgaacattaagcatagaggttgtcaaaagtcgacatcttttgttatcataaggatgtgaaattgatcacaaacaaacattacccctttgtttgaccgtgaaaaatttctcccatcccctttgttgtcgttaagacatatgaaaccgcgcttatcccggcgcggtttctttagtgctaaaaacagaacgtacgtttggttatggcgtaaaaaaacagcctcaagcatatgcacgcctgcggctatttttcacatgattgatattcatcagaataagtgctgagagacttccaaaacattccgtgtttggcttccactttggcaacctttttagcaaacgccagttttttcatttctttttctacctcttcaaggctcaggtcatatacaagagcaatttccttcgaggcaacgaagcggaaatattcaataaaacattctaaaggcggtgtttccgacggcttcggctcgtcgccaagcatctcaaataaaatttcttcatatacatcatatgagtagctgccaggaactttaagcccttcatcctcatgctgcgtattaaaaaacgtcagtgtcggattaacagaaacatccatctcagcagcaattttcatgtcacattgaagcgccttgaccgcgctttgagaatgcagatcttttttgaattcttcaagatcgagacttgtattttcagcaatctccaaaagcacgttttcatccgtaatatttttctttgaaacaaataggctctcctgcatatttctgagaaattgcatgccggcttttcgtccttgcaattcggctgctttaaaagcgagagcagccatataaggcgatgaaagcggctgatcctgttcgaaccagacattgccgtcacatgacatgccagagcggctcgcgatcttttcccatgcttctgcgagaagatgcttttttcgctttttatttaaagcggtaaggcttgcggaagcgataatgcgtaaggtgaaaaaacgtccgtatctgattttcagctttttgatgacgggctctaaggaccagcattcaggacataaagggtctacaaacatataaatttcaagcggtttttttggatgaccgtggcaatgggcgaagtatagctcatgctgatagtttgtcaagatgatcgatcctccgcttccgtttgattcaccatatgccttgctgtcaactccagccggccaaacaaaaactcacgaatttcgccctccagccctacatggtacattgcgtccttcatacagctgagccacgcatcagctctctcgtttgtaattggaaagggaagatgccttgctctgagcataggatggccgtgctcctcagtataaagcggaggcccgcctaaatactgagttaagaattgcttctgtttcctggcggtttctgtcaaatcgcttggaaaaatcggcttcagcaaaggatgagacgcgacacgctcataaaaagtatcaacaagttgcgatagaagttcctctccaatcgcttcataaggtgcgttaaacgattgtcccatgttgactactcctttaaatatggctaataggaatcataaatcctattgcaaaaagtaattttctgtatttcattgtttcatctagatttattttagcaacaaggcatcatttctacaaacaaactgccttttatgcgtttgatgacttatttcggctgacagccggggtttgtatttcatatcatatcacataaaaatcaggaatgcgtaagatttcacttcgcaaaaaaaccagagggaaagagcacctctggttacgcgtaataagctgaagttattttttttacatagttttgcgtttcttggaaaggaggaatgcctccgtatcggtcaacattccccggtccggcgttgtaagccgctaatgccatagacacattgccgtcgtatttatccagcatttgttttaaatatttcgttccgccctccacattttgctgcggatcaagcggattggaaacgccaagtgagcttgctgttgacggcatcagctgcatgaggcccatcgcacctactccgctgaccgcttttgcattaaagcctgattcctgtttgatgacggcgcggatcagtttttcatcaacgccatatttatcagcggcttttttaatcgcactgtcaatagaaaagtctcccgaactgatctgatttgctccatgtttgtttgaagctgaatctgcagcagctgtttcagtgctttctgccgcttttgtgattgaacctgaattgctgctcgtatatgagttaagcccatacgctgaaagcagtgacggcgctgttgtattcccgctgttcagcatgttgagcgggcttggcgatgaagaaggtgctgattgctgagatgccagaccgtttgtatattggctgagcaaagagctaaaacttgaaagcgggctttccgtattctgagtgtccgagctgctgcgtgcattagatatggactgtagtgcctgaagctgaagtaaagctgcccaattcgttacattcacgatgtcattccaccttatatagactttcgtttttcttcataaaaacgcagaattttatttttggtttcgcgctgaggaatgctgaattgctgaagcagcttctcgaaagcttttctgccctcatgccaatccgccgcctcaaattcaatttcatagtcctctttatttaaatatcggctgtggtctaaaactattaagcctttttctgtttctttttccgcacggtttgttgctaaagatccaaagtattgaatggcatccgtatcgatctgaagcttgtgcagctggtccttcacagggccctcgggaactgaaaatccagcgagatctgatacctctgaaagctgctggtgcgtttccagaagccccacatcagccggctcctttaatgtaaggacatactttccgttttttctgcggatacgaagcgcagcttgtttttgtttcagcgcgaagctgtctgtatcaaaataatgattcttttgatctgtaaaatctttttctgtcagctggagtgccgctgctatgtttttgaattcttgtttggtcagcatgtttttaaattcgatttcaatttcttggctcatgatgctcttcctttcctccctgtaaatcttatttttactattatctctttagatgttaggtttatcaatatcgagctcgatatgataaaatgaatctgtactttgtttaaaaaaggagagcattatgcaaaacagaatcgaaattttgaatgcaacattatcggatgatcagcttcgccttgcctgtcagacagaaggaaacgaagcggaacgcaagccgtcaggtcaaatgcttgttgattctgaccactttgcttttgtatacatacttgaattagctgattcttttgaatatgtcattataaaggaacatgtatggccggaactgaagcaggcccatgcacaaaaaataccggttgttttagaggcaggagaccaaacaattgaactggcaggcctgcatgaggagctggaatatcttttagaaaatataaaagataatgcaaactatggagaagaaatggaagaaaaagtgaaacgcgtgtttttatagaaactggttcggaattgggggatgtatgatggatgacaaacaatgggagcgttttttagtgccgtaccgccaggctgtcgaagagttgaaagtgaagctcaaggggatccgcacactatatgaatacgaggacgaccattcaccgatcgaatttgtgaccggacgcgtcaagcctgtggcgagcatacttgaaaaagcgagacggaaaagcataccgctgcatgaaattgaaaccatgcaggacattgctggccttagaatcatgtgccaatttgtcgatgacatccaaatcgtaaaagagatgctttttgccagaaaagatttcaccgttgtggatcagagggattatattgcggaacataaagagagcggataccgatcataccatcttgttgtgctgtaccctttgcagacggtatccggagaaaagcatgttctcgtagaaatacagatccgtacactggcgatgaatttttgggcgaccattgagcattcattgaattataaatacagcggaaacattcctgaaaaagtaaaactaaggcttcagcgcgcttctgaagcggcttcccggcttgatgaagagatgtcggagatcaggggtgaagtacaggaagctcaagctgccttttcaagaaagaaaaaaggaagcgagcaacaataggtaaaggggaagaagagcatgaaatttgccgtatcatcaaaaggagatcaagtttctgatacgctgaaaagcaaaatacaggcgtatttattggattttgatatggaactggatgaaaatgaaccggaaatcgttatttcagtcggaggcgacggaacgcttttgtatgcttttcacagatacagcgaccgcttggacaaaacagcatttgtcggcgttcacacaggtcatctgggtttttatgccgactgggttcctcatgaaattgaaaaacttgttcttgccatcgcgaaaacgccgtatcatacagtcgaatatccgcttctcgaagtcattgtgacctatcacgaaaacgagcgggaagaaagatacttagctttgaatgaatgtacgattaaaagcatcgaaggaagccttgttgctgatgtggaaatcaaagggcagctctttgaaaccttccgaggcgacggcctctgcctgtcaactccatcaggcagcacagcctacaataaggcgctgggcggagcgattatccatccgtctatcagggcgatccagcttgcggaaatggcttctattaataaccgcgtgttccgtacggtcgggtcacctctgcttctcccatcccatcatgattgcatgattaagccgagaaacgaagttgactttcaagtgacgattgaccatttaacccttctccataaggatgtaaagtcgatccgctgccaagttgcatccgaaaaagtgcggtttgcgagattccgtccgtttccattttggaaaagagtccaggattcgtttattggaaaaggtgaatagaaagaggacatatcgtggagcatttttttatcagaaagaacattacttccgctgaggacgggatgactgtaaaagaatatgccagtgaactgggaatttcgaaacgtctgctgaccgatattaagtttggcgggggagacctgcagattaacggtgagcatgtgacggtcaaatacgttttgaaagatggagatcttcttatcgtgaagtttcctgaggagcaggtgagcgagacgctgttggcagagcctgttccgctcgatatcctttatgaggatgaacatgtgcttgtgataaacaagcagccgtatgtgtcatcaatcccttcgagagagcacccctccggcagcattgccaatggaattattgatcattatcaaacaaccggagtgagggcgacagttcatcttgtcacccggttagaccgggatacatcaggtgtcatgcttgttgccaagcatcgatttgcccactccattttatcgtctgcgcaaaaaaacggccttgtgaaacgccggtatgcggcagtggttcacgggcggatggcacagatggagggaacagtcgatgctccgattggcagacatcctgacagtattattgaacggacggtaacgccagacggccagaaggctgttactcatttttacgtcacatgtgcaaatgacgacatgacctcggtggcattgcagcttgagactggacgaacccatcaaattcgtgttcatatgagttatctcgggcacccgttgtgcggcgatacactgtacggcggaacgagacaggaaattgaccggcaggctctgcacagcgagcatctttcgtttatccatccgctgacacaggagaacatgacgtttcatgctccactgcctcaggatatgagaaaactgataaaaggagagaatcattgattctctccttttttatatggggcgaaatcttgattcgtcgtaaggcagggagcttggaacagagacggtttctatttctggaaagcgaaagcctgtcagttgatttccgaacacgcagcctgtatcaatgttgatggtgcgattgaccttccgaggctctttcacaggtgtatgaccgtataccacccaagcctttccgttataggctgccgcccaatcacgtctgacgggtctgccgtccggatatgtttcacccgtcacgtcaccgtaaagcacaaagtccttcactctgcgggtatatttgccgatatcgtcagctcttatgccagcatgggcgacaactaattctccattatgtaagatgtcgtaaagcggcgctgtttcgtacagcttcataaactgttcgctgactgattttttctcatctttggaaagttcctcaagctctgccgctgttgtttcgagaccatgcatcacttttaccggatttccttttaagtaacgatataatttattgcaatggtttcccgggacataacgcacagcgcctttttcgtaagcgccggctacaaatcggatgacctctatcgatttgggccctctgtcagttaaatctccggcaaaaacaagcaccctgccttcttcatggacaggtactccatttttgattgtatagccaagcttttggattaatgcagtcatttcgtcatagcagccatgaatatcgctgatgatatcgtaagccatgcggtctcctccttaccgattgttttatttattatgaagcaaagtgttgtgagtcatcacaagcttttatgtgcaaattatagaagaagaatcattttctaaacaggattaagaccttatcactttatttttcatcatcacccttgttaaaatcgcgttatgttttttaaaaatgaggttttgttctctgagtgagaactagcataaccctgacttaaaaaggaggttctgattatggcgcatacatctgtcgcatctttagttgttgtacttatcgttgcatttttgacacccatccttttgcatcggtttaaactcagcatcccggttgttgttgctgaaatcattatggggctgataattgggaaaagcggccttaatttagttgtggagggtgacacctggctccagacactctctatgctcggatttatctttttaatgtttttaagcgggcttgaaattgatttttcgtcgtttgagaaaggaaagaaaaagcagttcctgccgaatggcaaggaagcgccgaatacgtttgctgcggcatctgttattttcgtcggtatttttattttatcattgctcttgtcctatgggttcgtcttggccggatttatccaaaatgcatttttgatgaccctgattatttcaacgatttcattaggcgttgtcgttccaacattaaaagaagaacggatcatgaattcgaatatcgggcagattattttgcttgttgctgttattgctgatttggccacgatgattcttcttgctgttttttcttctttatacggagaggacagcggaaacatgtggctcctgatgattctgtttgcggccggagtggtgctttactttttcggccgggtcttcaaacatcgctcttttgttcaatccatgtcaaaagggacgatccagatcgggacgcgtgccatttttacgttaatcattgtactcgttgccctgtctgaatcacttggggcggaaaatattctcggcgctttcttagcgggggttcttgtttccctgctttcgccaaacaaagaacttgttcagcagctggattcattcggttatgggttcttaataccgattttcttcgtgatggtcggtgtgaagcttgatatttggactcttttccaggataaaacaattttaatcatgattccgctcctgctgctggcgctgttagtcagcaaaatcattcctgtcatgtacttaaagaagtggtatgataaccgaaccattttcgcgtctggtttcctgctgacatcaacgctttcgctcgtgattgccgctgcaacaatcggccagcagcttcacgtgatcagtgcaaatatgtcaggagcgctaattttagtagccgtcattgcaagtatttttacgccgatctgttttaaaaaattatacaaacgggaagagcagccggaggagaaaaagacgattacgttcattggcgccaatcaaatgactttgcctgtcacactcgaattgccagaggaagagtatgacgtgcgtgttgtacacgtctaccaagagaatgcggaggaaaagctgtcagaatcagtgtttgctgttgaaacaatttctgactatgaacacgagacgcttgaatcactcggcatttttgaaacggatatcctcgttgtggcgacaggaaatgaagatatgaatgcagacattgcattacttgcaaaagaaaaaggcacagaaagagtcattgcaagcgtaggatcaccggagcatgaagcagctctgaaggagcagggaatcagcatcttttctattctgctgtcgacaaaaacgctgcttcgcgcactgattgaagcgcctggcgtcatgaagctgctcacgaaccaagagtcttcgctgtatcaaattaatatggagaacagtaaatatgatggtgtcattttacgggaattccctttaacaggtgacgtcatctttgtcaggatcttcagaggtgtggacagcatcgttcctcatggggatacaaggctgaaacttggagaccgtttaattgtcaccggatctcgggggtacgtaacggatcttaagaaaacattggaaggataaatcttgaccaaataaggattcgtgttaatatagaggtgcagaacaattcaatatgtattcgtttaaccactaggggtgtccttcataagggctgagataaaagtgtgacttttagaccctcataacttgaacaggttcagacctgcgtagggaagtggagcggtatttgtgttattttactatgccaattccaaaccacttttccttgcgggaaagtggtttttttattttcagagggggaatgatttgtgaagttttcagaagaatgccgcagtgcagccgcagaatggtgggaggggagctttgtccatccgttcgttcaaggaatcggtgacggaactcttccgattgaccgttttaaatactacgtacttcaggattcctattatttaacgcattttgcaaaggtgcagtcatttggcgccgcttatgcgaaggatctttatacaacggggcggatggcaagtcatgcccaaggtacatatgaggcggaaatggcgcttcatcgcgagtttgccgagctgttggaaatcagcgaggaagagcgtaaggcgtttaagccgtctcctacggcgtactcttatacatcccatatgtaccgttcggttttgagcgggaatttcgcagaaatcttagcggccttgctgccatgctattggctctattacgaggttggtgagaaattgctgcattgtgatccggggcatccaatttatcagaagtggattggcacatatggcggtgattggtttagacaacaggtcgaggagcaaatcaaccgctttgatgagctggcggaaaacagcacggaggaagtgcgtgccaagatgaaagagaattttgtcatctccagctactatgaatatcaattttggggaatggcctatcgaaaagaaggctggtctgacagcggcataaaagaggtggaggaatgtggagcttcacgccataacggatgacagcaagccggtagaagagctagcgagaatcatcattacgattcagaatgaagttgattttattcatattcgggaacgttcaaaatcggcggcagatattttgaaactgctcgagcttatttttgaaggcggtatagataaacgaaaactggtgatgaacgggcgcgtggatattgcgcttttctctactattcaccgcgtgcagctgccaagcggcagcttttcaccgaagcaggtcagggccagatttccacaccttcatatcgggaggtcggtgcattcactggaggaagcggttcaagcagaaaaggaagacgcggactacgtgctgttcggccatgtgtttgaaacggattgcaaaaagggtcttgaaggcagaggagtatctttgctgtcagatatcaaacagcggatttccatcccggttatagccatcggggggatgacgccggacaggttaagcgacgtaaaacaagcaggggcagacggcatcgctgttatgtcaggaattttctcttccgctgagcccttggaagcagccagacgatattcccgcaagctaaaggagatgcgctatgaaaaggcattatgaagcagtggtgattggaggcggaattatcggttccgcgattgcttattatttggcaaaggaaaacaaaagcaccgcattgtttgaaagcggaacaatgggcggcagaacgacaagtgccgctgccggaatgctgggcgcccatgccgaatgcgaggaacgtgacgcgttttttgatttcgccatgcacagccagcgtctgtacaaaggtcttggagaagagctttatgcattatccggtgtggatatcaggcagcataacggcggtatgtttaagcttgcattttctgaagaagatgtgctgcagctgagacagatggacgatttggactctgtcagctggtattcaaaagaagaggtgttagaaaaagagccgtatgcgtctggtgacatctttggtgcatcttttattcaggatgatgtgcatgtggagccttattttgtttgcaaggcatatgtgaaagcagcaaaaatgcttggggcggagatttttgagcatacgcccgtcctgcatgtcgaacgtgacggtgaagccctgttcatcaagacccctagcgaagacgtatgggctaatcatgttgtcgttgccagcggggtgtggagcgggatgttttttaaacagctcggactgaacaatgcttttctccctgtaaaaggggagtgcctgtccgtttggaatgatgatatcccgctgacaaaaacgctttaccatgatcactgctatatcgtaccgagaaaaagcggcaaactggttgtcggcgcgacaatgaagccgggggactggagtgaaacaccggatcttggcggattggaatcggttatgaaaaaagcaaaaacgatgctgccggctatacagaatatgaaggtggatcgtttttgggcgggactccggccgggaacaaaggatggaaaaccgtacatcggcagacatcctgaggacagccgtattttatttgcggcgggccatttcagaaacgggatcctgcttgctcccgcaacgggcgctttgatcagtgatctcatcatgaataaagaggtcaaccaagactggctgcacgcattccgaattgatcgcaaggaggcggttcagatatgatgctacagctgaacggtaaagacgtgaagtgggaaaaagacacaggtacaattcaagacctgctggcgtcttatcagcttgaaaataaaattgttatcgtggaaagaaataaagaaataatcgggaaagaacgctatcacgaggttgagctttgtgatcgtgatgtcattgaaattgtccattttgtaggaggcggatgagcatgttaacaattggcggaaaatcatttcaatcaagattgctgctgggcacggggaaatacccatcgtttgacattcaaaaggaagcagtagctgtttccgagtctgatattttaacctttgctgtgcggagaatgaacatctttgaagcatctcagccgaattttctggaacagcttgatttatccaaatatacgcttttgccgaatacagcgggcgccagcagtgctgaagaagcggttcggattgcaaggctggcaaaagcgtcaggcctttgtgacatgattaaagttgaagtcatcggatgcagccgttccttgctgcctgaccctgttgagacattaaaagcgtctgaacagcttcttgaagaaggctttattgtgctcccgtacacgtcggatgacgttgtgctggcgagaaagctggaagagctcggcgttcatgccatcatgccgggtgcatctccgattggatcgggacaaggaatcttaaatcctttgaatctgtcatttattattgaacaggcgaaagtgccggtcatcgtggatgcgggaatcggctcgcctaaagatgcggcatacgcaatggagcttggagcggatggcgtactgctcaatacggctgtatcgggcgctgacgatcctgtgaaaatggctcgtgccatgaagctcgcggtggaagcaggacgcctttcttatgaggcgggccgaatcccgcttaagcaatacggaacggcaagcagtccgggagaaggtcttcctgtatgacaggcaggtattcaaggcaggagctgtttgctccgatcggcccatccggccagaaaaaattgaaagaagcgcgcgccgtgattatcggcgccggcgcgctcggaacagccagtgcagaaatgctggtgagagcgggagtcggctctgtgaaaattgccgacagagattatgttgaatggagcaacctccagcgccagcagctttatacagaagatgatgtcaaaaaagaaatgccgaaagcagccgctgcggagcgccgtctccgttcgattaacagcgatgttgatgtgaccggccttgtcatggatgtgacagcagaaaatatcttcgagctgattagggatgcatcaattatagtggatgcggctgataattttgaaacccgcctgatcgtaaatgatgctgcggtaaaggaagggattccttttctttacggtgcctgtgtagggagctacggcctcacctttaccgtggtgccgggttctactccttgcctgcattgcttactcgatgcacttccgattggcggagcaacatgtgacacagccggcatcatcagtccggctgttttgcaggtagcagtctttcaggtaacagatgcactgaagctgctgacgggagaggagtgcgagccggtgctgcgctcctttgatttgtggaaaaatgagcggtcagaagtgagagcggccagtctcaaacatgacgcatgcccaagctgcggcacaaaggattttccgtttttgtcatatgaaaatcaaacaaaagcggctgtattgtgcggcaggaacacggtgcagatcagatcatctattacgaaagaagcggatcttgaagcgcttgccggtcagctgaggcaggccgggcttgaagtagctgcgaacccgtatttaatttcctgccgctcggatgatatgaaaatggtgctgttccgggacggcagagctttgatccatggaacaaatgatattgcccgggcaaaatccatttatcataaatggatcgggtaataaaaggagtgtagtgtaatgagtatatataaagcattgacaatcgccggatcagattcaggcggcggcgcagggatacaggctgatattaaaacctttcaagagcttgaggtattcggaatgtctgcgattacagcggtaaccgctcaaaatacgcttggcgttcatggggtgcatccgctgactgtagaggcgttgagacagcaaattgacgctgttgctgaggatttgagaccggatgcagtcaaaacgggaatgctctggaatgccgacatgattgaagaagtggcaagaaaaattgacgagtacggattcaatcgtgtaattgttgatccggttatgatcgcaaagggcggggcatccttgctgcgtgatgagtcagttgccaccttaaaggagttgctcattccaagaagctacgcgattacgccgaatgtcccggaagcagaaacgctgacaggaatgacaatcagctcgctggatgaccggaaaaaagcagcggagcagctcgtcaagatgggtgcgcagcatgtcattatcaaaggcgggcaccagcctgaggacaatcacattactgaccttctttttgatggcagcatgtttatgcaaatcacccatccttatatcaatacgaagcatacgcatggcacaggctgcacctttgctgcagctttaacggcccaaacggctaaaggagacagcatccatcaggcatttgaagttgcggccaactttgtccgtgaagcggtggaaaatacgctcggcatcggatcgggacacgggccgacaaaccatttcgcttttaaacgaaacagcttaaatacaagccgatgagatcaccagctgatggtgatctcttttgcgtttgctacggtatgcgcttttcatctggacaaggttatgatatgataggaattaagatcaggtactaatactatgtctttattaaatataggaggctttatacatatgaatttttcacttgaaggccgcaacattgttgtgatgggggtagccaataaacgcagcatcgcctggggcattgcgcgttctttacatgaagcgggtgcacgtttgattttcacatacgctggtgaacgcctggagaaatccgttcacgagcttgctggaacattagaccgcaacgattccatcatcctcccttgcgatgttacaaacgacgcagaaatcgaaacttgcttcgcaagcattaaggagcaggtcggtgtaatccacggtatcgcgcattgtatcgcgtttgccaacaaggaagagcttgtcggcgaatacttaaacacaaatcgtgacggcttccttttggctcataacatcagctcatattctctgactgctgttgtcaaagcggcacgtccgatgatgactgaaggcggaagcattgtcactttgacgtaccttggcggagagcttgtgatgccaaactacaacgttatgggtgtagcaaaagcttctcttgatgcaagtgtgaaatatttagctgctgacttaggaaaagaaaatatccgcgtcaacagcatttctgccggcccgatcagaacattatctgctaaaggcatcagcgatttcaactctatcttaaaagacatcgaagagcgtgcaccgcttcgccgcacgacaacacctgaagaagtgggcgatacagctgcgttcttgttcagcgatatgtcccgcgggattacaggtgaaaatcttcacgttgattcaggtttccatatcactgcccgctaagcaggatctatttcaagcaatcccgaatagggattgcttttttatttcttctgattttcagctttctgtcatatagatagaatatgacacaatcggagggatgaagatgtctaataagaaaagaaacgcggataaaaaaccgctcatgtatattgttcagccggattatgcagaaactacaagatcatccatgcaggagattgtcatcaaaagaaaggccgacaaacccgctccgccaaaagctgaggaaaagccggtttaccatgagaagcagcaggaggaagctgtggcacaggatgtcctgcaagaagaccaaaagcctgcagccgaaccagtgagtcagcaaactcaagaggtgagagaaccagagaacataaaaagccaagaggaacagaaagcagagccgcaggccgtagaagaaaccgttgaacacgagcccccgaaagcagaaaaaaaggaagagcctgcacttgaggcccggaagcctgagaaagaaccggaagctgtccatagtgctgataaagcggaggaaaaagcaccgccggcacgaaaagtgaaaaaaccgatgagcaagatgacgatccacgaaaaaattgattttttaacaaagctgcctcataacatgccgagagcgctttgtttgattgaagccaatggaagaacgtacaggggcgtgattgtcggaagaagaaatgattccgtcctgcttcgaacaaccggaaacggagccccaaccgaactggcaatcgatgatattacctctttgcacccgctcggtttttaacgaaaaagaaaaaagctgcccggctgatgttgccggacagcttttttacatagagaaaagcctgcggcttgcaagcttttccagcttatgattaatgctgatgatgtgtacgattgattaatcgaggatttaagcagttgattgcgcagaagcagtctaagtcaacttcaatacagtagttcgttttttcgagtcggaacacttcacacaccgtatctttatcggtgaagtccaaaatgtgtttgtgttcgtcaaatgcgattaataatgacagtgttgcgcagcttccatgcactctttcgaccctgaaaaatactgtattaaagcaagggccgttatcgagttcgccgacatttccgaaggcgactaatggcgttgattttgatgtaaatattgcaaaaggcactgtgtcgcctaacgaatggcttacagataaaagcttagagtggcagccggtcgggcagtcttcttcaacagcgttttgcagatcttcaatattttctacagcttcacgcacgcagcttgatgttttctggctcatattatccctcctgccttataaatttgagactggcgaaatgatggagagtcagctgcctcacgcaggaagcagctgaatgatttgcacctgtaatagagtttggaaggggattcctctttacaagtgtttatccattgtgatgatgctttttatctttatgaggcgatgttctgtcaactagctctggtgacaggcactgaatcgcgcagaagcatccgagatccacttcaatgcagaaatctgttttttctagcccgaagaaatccgggtcgcaaggatggcaaacacttaaggtatcgcctttaacatcgacagggcgtaaaatagacagtgttgcgcagcaatcacataatttttcaacgcggaagaaaatggattcaaagcattgcatatcatccacaaatccccccacgtttccgaatgtggagaacaatccgccttttttatcaaacaagagaaacggaattgtgtctttacctgcaattgtcggattcaaaaggtttgtatagcagccagtcggacactgttcctcaactgcctcctgctctgctaaaatcttttccactgcatcgcatacacagttctcatgccggccatgggtttttccgcagctcattgatttcagctccttctttatagggtatttgactttagtccttaacaacatatgtacccgtgccccacttggtgtgggtgaacgtctatatattcatcatatgcttggaaaataagaaaaagcagagcgtttttagctctgcttttaggttctagaggacaagagtgatgactaggacagcgatcagaacgtttgtagctgtagagacaagggttgcgatatcggcatctactgttgtgacgtttacgccgcgggagcattcgataagaagtttctggcggtttacttgcttgttagctgtaagctgcaataaatcttgtgcgactaattcagcaataacgccatctgcaatggaggtgagagctactgtcaagacagctgcattaagcgctgttacaatagatgttacggcttgaacgtctgtagatgaaacgttgatgtcacaagagtctctaataataatcgtctcatctgagacttgtttgttgagatttgcctgagctagatcttggtcgataaaggcgttgttgtcattgccaaacccattgttattgcagcaaatatcgcaattgcattttctttcttctttttctttctctttgtgctctaacggatggtcacagtcaggatcaagtgcaacccaagagtatggtctgctttccatatctattcctccttttcttttactgttattaaatgagcgagcctcttactttgactgaggcatttatcttgatgatgtgccctattttttatgattaatttgaattgttattgttttgccgtctttgtctgagctgttcaatgagctgctctctgcggctaagcggtttatcgctcttttgctcttgtacggcttcttcttcttttttcttcttgtgtttttcagctagctccgctgatttcgcttgcaggtcttttaccatattcaaaagcatttctttttcttcatctgatacttttttcattttgtcttttgtgatgccgtgttttacaaatatgttttggaccagcattttcatcattggatcaacttctgggagcttttcaagctcttctttgattttatcgttatctgacatttgttctcacctcaacttttagtttgtgaaaagaaagggttaaaggatgtcgaattcaagtagcatactgtttaacacctgaagcaagatttgtacaaaggttattatttcgtctgcagacaaagtaatcttgatgtttcggctgttgataattttaatgatggttctttttttgatttgagagttatcgagaatgagtatttcgcttgctactgtgtcggccaagtcctcgtcggcaataacgagctgtgtcagcaggataatcaatgttgtaaccaaggcttgtatagaaagggcagatgttatatgtgacgtatctattgtgatattttcgcaatcaatcacttcgatctgctgctcgaattcgcttgataattgctcaaatatgtcaggatgcagggattcaatttttgtttcaaatgacataaccttcactcctttcttatccatactctatataatgcaaatggggtgcagagcggaataataaaaataaccaattttctgccggacaagatacaattcatgaagaatagggttttcgcatatatgtgaagggatcatgattggcaaaggagtgaacgagtggttataaatgggctgacaattgttcttctatcgcttgcggtctttcggctcgcccgcctgctggtgtttgacacgattatggcgccgcttcgcagtctgtttcatgaagagaaggaagaaaaggatgcggacgggaatattcaaacctatatcgtgattaaaggaaccggtgtcagggcgtttattggtgaattgctgagctgctattggtgcacaggcgtgtggtgcgccggctttttgattttatgccaggcgttgatcccgcaagcggcgcagtggctgattttacttttggcgatcgccggccttgccggcatcatagaaacgctcgtatcaaaatggctgcaagaatgaggcgttaccaccagcaacttttcactagcatcagcataaagtagcatatatgacataaggaaaggaagggaacaaaatgaatcaattcaataaaccttcccaaaaatctccatatacagattcgtcgtatcaatcaaaaaagataaaaaagaaaggctgcgggtgcggaaataaaaagaaaaagcctcaatagcctggcaaagaaaccggagaactccggttttttgttttttaacggagcggcctcgctcagcatatatcataagcggggggataaaagtgaatgagtttgaaaaatggatagaaggaagatatgaaccacacgaacaaaagcaaaaagagtatgaagacacgatgggccgtatcagaaaagacttggatgcatttgataaagccggtctggaatttgaagatgagattgaagagctggctgaaaaaacggaggccttacttaaaaaacatcaagctcaatatgatcaatcgtaaatccgcaaacgccctatgcgaatatccaagccgatccaatcagctcacatagtgtatagagagtaaaggaggtgcttatctatgggctttggatacggattcggcggcggctacggcggcggctgttatggcggttatgctggcggttacggcggcggctatggttcaacatttgttttgttggtcgtattattcattctcctcatcatcgtaggtgcatctttcttttaagatgtattgaggaagtacgggttataacccgtgcttccttgccttgtgtttatttttaaaaatgttggaaaagcacattgtattatgtgcattcatacaataccgtattactccgccaaaaggaggcgcattatggataatcaattttttaagaacatcgaaaagaaaacaggtgtgaagatgcaggatgtaatgaatcttgccggatcactccaaaacgctaattttaaagatgaaaatacagtgcgcagtgtgattaaccgcgtagctcagatggcaaacagacgcgtgccaaaagaattagaagataaaattgtggaatctattacaagcggaaaagaaaagcttgattttggcacgatttctaaaatgatggataataaataagtggatggcctggctgactcactgcagcgggcctttttttacagtaaaaacccggcagtaatctgccggactgttaatgatgcaagggctgtcttgctttttgtagaaggggatacaaaaatcttgagcggttggctgttttgccgcgcctgttagcggggcaagacaaatataaatgctgtttcgcccgggtcatggctacatataaaagacgtctttcctcctcaagagcggcctcgtctccttttcttgccgtttctaatgagaaatcgtgcggaatcgagccgtctacagtgcctaacacgtagactgttttgaattcaaggccttttgaccggtgaatggtcatcagctgaacgccatgttcatccgttctgtttttctcagcggccctcatatggtctacgtgggcaagaaagtcaggaatcgttttgaacttcttggcgacaaccttgatgtcgcgcaggtcatcggaacctttttccagcttgttgccctcattgccccgcttttttaaatactcggagaagcccatttttccttctgcaaaggtgatggcttctacgggcttcatcgtgcggaggcttgcaaaaaacggtacgattttcttgattttgtccagctggaatggcttcagatcaggcaatttggccagcgctttgatcatggtacagtcctctgtaatcgagagcgccttcagcgtattcaaagcggactgttttaaaaacaaggcgggaagcaagtgtttaatcgcctcggtgtcatcctcattttggctggcatacaagtaggcgagaatctggcggacgatccgtctgctgtaaaacgattggacgccgcggtcagctgtatacggaattgatgattgatgaagcctttcataaatagcacggcctccgctgtttgtgcggtacagaaccgcaaagtcttctggactggctccattttgaattttttctttgatatcggaaacgaccattgtggcttcttcctcttcatcataaggataaaacagcacagggacctgaatgtcatcgcgggccgcttcaagcgttttggcatatctgtttttgttctttttcacaacgatatcagcactagagacgatcgggtgcgtagacctgtagttcgcagttaaatagatcgtcttcgctcccggataatccttttgaaaatcaagaatgaaagacggattgcttccgcgaaacgcgtagatggactggtcatcgtctccgacacagcacaggttttgctccggactggcgagcatttgcatgattttgtattgaaccggattaatgtcctgaaactcatcaattaagatatacgtaaaccgagattgatattgttccagaaggtcaggccgctcgataaacaattcatagcaggctgaagccatgtcatcaaaatcaaattggctgtgttcttttttctggcgttcataatgttcatataaacgataaacttgtttttcccactcatcttttagagggatgcgttcatttgggacataagtgtttttccaaaaaccgatctgctgcagagcttggtcaactgggaattctttctcatcgatgccttcttcatagagtgcttttttgatatattgttcccgctgccactccattttcagcagatgctcaccgttccatttagcagaattagagtgatacaagatcttataaaacagactgtggaatgttcctgtcacaagtcttctgacttttgccggctgtaatccgtactggttggccatacgctctttcatttcagcgacagcttttgttgtaaaggtgacaagcagcatattttcaggcggtatgcctaagtgttcgatcatgtgggcggcacgggctgtcagcacccgtgtttttccgctccccgcacctgcaagcacgagcagcgggccctctgtttccgtgacagctttcagctgatccgtgtttaaaccgacagacggaaaaaggctcgtatcgggttctattgtttttggcacaaatggtgttcctggtttaatgcttctaggacggtgccattccgtaacagctggggacgggtcagcggcgatcgcttttcccttgggtaaacgaatgacaccagattcctgatcgtcttcttttttttcctctttagagggcttcggttcgcacgcctcctcacatgccggaaaatcgcctggctggcgatggataaactctggcggatcggcgatgttaagccgtaacaaaacgggctttccgcaatgagaacaaaataaatgtccttttattccctcttcaaagaggaattgataatgttctctcgaatatgtatgtaaatgtatgattctatcattcagtcgggcgcatttcaaaaaggggtcctcccaatcaaaaggtgttcattacagacaatgactatcatatcaaaagaaatgtgtttcaaaaagtaagtttaagggaaaagagacagcagaggggtgggtattgtatgatatatgcaggtcaaattcagaaccagcaatacgctcaatatgctaatagaacgattggacataagcaggattatgccggaaccgaaaaaatcagctatgtcccgtttcagcgggtatacaaagaactggaaaagcagcaggagaatcaaacggcagctgaaagaaaagtaaacgagatgaaacgtaagcgctctctttataagagattgcgagaaaaaggaatgggcacatatattaatcgatatgtataaaaaaccgttcataccagagaacggtttttttatatgcagtaaaaatccggatctcaaaagatccggatgcgttcagtccttcatcatttgtaagtgcggaatgccggcatcgaggaattctttttcagaaagcacgcgatacccgtgtttcttgtaaaacggcacagcctgtgtttgcgcgtttaaaatgaaaccggaagcgcctccgtctgccgcggctttttcgagcgctttcataatgatgccgccgacaccggctgagcggtggcttttcagtacgcaaatccgctctaacttgccgtagccgtccttcatgcgccatcttccggcaccgacaggcttttcaccgtcatacacgatgatatgctctgactcattttcaagttcgtcaatttcttcttcagcaggcacgttttgttctttgacaaagacttcttctcttacatagaatgcatctttcagttgttcttcattttttgcgataactgctttcaaacattattctcctctgcctagcaagaaggtttcatatactgtccacgatccgttttccagctggtaaagcaagtggaaacggtcaacgatttcttcatgcgacacttcctgcatttttaattgtcccagcacatctgaatgctcatcgtcggagagattttggccgaccgtcacatgcggaacgaaattatattcctgttctcctgccaacacaccggtgtatagcttttcattgagtgtttttaactcttccgtcggttctgctttgatgtaaatgacattattgacaggcgcaaatgagctgtattttgtcattttgagaacgagtgggtgggactcttttgcgatgtttcttaaatgtgatacgagctgatccgctttctcctccgcgcattcaaaggatgctctcagcgtcaaatgaggcgggattagagagtagcttgggtcatagcgctttctgtaagagtttgcaaggtcttggagcttttttgatggaaataaaacgattccgtatttcatattatgtccctcctggaaataaagtatgatagagtgttaaagcatttttttcagcgccggggtgatgagcggctgccagtatgtccatttgtggtctccgtcaaatggctcgaaatcataatcggaaagctttttctccagcagctgtttcagctcccggttcggttctgtaaagtccagaatgttcccgtctgtcgtgtggacgtcagtttcttttgttccgatttggtgataaatagagaggtgtttgatatcgtctgactgttttacggcttctagtacgtgtttgtcaacatagggagactgcatgatgatgttgccaaacatattcggataatcaagcgctgtcataagtgacacggttgctccgagcgaatcacctatcagcgttcggccgtaaccgatctgataggttggatactcatcatctgcaaaaggaacgagctcatgggcgatgaaccgtttataagccgaaaattttgaaccctccggatgataggtgtttctgcgctcttttacatccttataaggaacaccgataataatgctccggtctatttcgcgtttcgacagcaattcctcaacctgtctgccgattctccccagcctgaaataatcgtggccgtcctgcgcgataatgacatggtatttataaagcggggagtagttggacggcagataaacaagcaaggtcatttcctcgttaagctcttttgaaaagaatttcttttcttgcactgtgccgtttttcggtgccataaaaacattcctccaggacatcactatactttcttgcattttcaattattgtaccatgaattattagaaatttctctctttaaacggttcggcacacgaagaaaaaagtgttgaaataaactgtgaattgcgctaatataaaacaatcagaaaattgaaatcgatatttcttatcgtgagaggtggagggactggcccttagaaacctcagcaaccggcttgttttgcatgtgcaaagcgccaaggtgctaaatccagcaagcgttttttatgcttggaagataagaagaagcgttaaaccccttcttcttatgaagaaggggtttttattttgaaaagggaaggtgtcagctatatgtcacagcacgttgaaacgaaattagcccaaattgggaaccgtagcgatgaagtcacgggaacagtgagtgctcctatctatttatcaacagcataccgccacagagggatcggagaatctaccggatttgattatgtccgcacaaaaaatccgacacgccagcttgttgaggacgccatcgctaacttagaaaacggcgcgagagggcttgcctttagttcgggaatggctgctatccaaacgattatggcgctgtttaaaagcggagatgaactgatcgtttcatcggacctatatggcggcacgtaccgtttatttgaaaatgaatggaaaaaatacggattgacttttcattatgatgatttcagcgatgaggactgtttacgctctaagattacgccgaatacaaaagcggtgtttgtggaaacgccgacaaaccccctcatgcaggaggcggacattgaacatattgcccggatgacaaaggagcacggtcttctgctgatcgtagataatacattttatacaccggtcttgcagcggccgcttgagctgggagctgacattgtcattcacagcgcaaccaagtatttaggcgggcataacgatctgcttgctggacttgtcgtggtgaaggatgagcggctcggagaggaaatgtttcagcatcaaaatgcgatcggcgccgtcctgccgccatttgattcgtggcttctgatgagaggaatgaagacgctgagcctcagaatgcgtcagcatcaggcaaacgcgcaggagcttgcggcgtttttagaagagcaggaagaaatttcggatgtgctgtatcccggaaaaggcggcatgctgtccttccgtctgcaaaaagaagaatgggttaatccgtttttaaaagcactgaagaccatttgttttgcagaaagcctcggcggggtggaaagctttattacataccctgcgacccagacgcacatggatattcctgaagagatccgcatcgcaaacggggtgtgcaatcggttgctgcgcttttctgtcggtattgaacatgcggaagatttaaaagaggatctaaaacaggcattatgtcaggtcaaagagggagctgtttcatttgagtaaacacaattggacgctggaaacccagctcgtgcacaatccatttaaaacagacggcggaaccggggcggtcagtgtaccgattcagcacgcctcgacttttcaccaatcttcatttgaagagttcggggcatatgattacagccgctctggcacgccgacaagaacagctctcgaagaaacaattgccgcattggaaggcggaacaagaggatttgctttcagttcaggcatggctgctatctcaacagcatttttactgctgtcacagggtgatcacgttcttgtgacagaagatgtatacggcggaaccttccgtatggtgacagaggtgctgacccggtttggcattgagcatacgtttgtcgacatgacggatcgtaatgaagtggcgcggagcatcaagccgaacacaaaggtcatttatatggagacgccatcaaatccgacacttgggattacggatattaaagcagttgttcagcttgcaaaagaaaacggctgcctgacctttctggacaatacattcatgacaccggcactgcaacgtccgcttgatctcggcgtggatattgtacttcacagcgcgacaaaattcttaagcggacacagcgatgtactctcaggtttagctgctgtcaaggatgaagagcttgggaagcagctgtataagctgcaaaacgcgttcggcgccgtccttggcgtgcaagattgctggctcgtgctgcgcggcttaaaaacgttgcaggtccgtttagagaaagcgagccaaacagcgcagcggcttgcggaatttttccagaagcatccggcggtgaagcgcgtgtattatccgggactggctgatcatcccggcgctgaaacccataaaagccagtcaacgggagcgggcgccgtactatcttttgagcttgaaagcaaagaggccgttaagaagttagtcgagaatgtgtcacttccagtcttcgctgtcagccttggcgccgtggaatcgattttgtcctatccggcaacgatgtctcacgcggcaatgcctaaggaagagcgtgaaaaacgcggtatcactgatggcctgctccgtctgagtgtgggcgtcgaacatgcagacgatttagaacacgatttcgaacaagcgctgaaagaaattgctccagttgcggttcgttaaaaaagaagccggggatggcccggcttcttttattattgttcgtcatcaggattcagaatcgcgaggacttgatgatcctcccaaacgccattaatttttacattttttcgggcgatgccttctttatgaaatcccgctttttctaaaacacgcatggacccgagattacggggcatcacaccggcttcaatccgatgcagtttcaattcgtggaacgcataatcaacaaccaatctgactgcctctgtcataatgccctttccattatgggctttgtctaaaaaatacccgatgaacgcagtttgcagcgcgccacggatgatttgaaagagcgaaaccgtcccgattaatctatcgtctgacgctgtaaagatgccaaaatgatattcttcatctttctcaagtctttcctgatactcggttattcgttttctttgcccctcaaccgtatagtaatcgtctgcgcgtatcatagaaaactgttcgaaaaaatcccgattttcgctttgcagccgcaaattttcttcggcatccgttacttctaaaggtctaacataaatggtttttccttttaacatacagtgatctctccgttctcatgtcagcattcctcttacattattctcagggaaatgcaaatatcctttttataagaaggaagaaaaccaatttcccataaaagtgccaacatagttgccgattaagtagccgagcgtaccgacaagcatgatcggggcaacaagctcccgccatcccttggcaattgccatcgcagccgcagtcgtcggtcccccgacagtagcgttgacggcgagcagaatttcttcaagctgcacacggaacaattttccggcagctaaggaaaccgctaaattgctgatcgcaatgataaacacgaataatagaataagaggcgcattcgtgacgattaaacggagatctgcaggaatgccgatcaccacaaaaaacaaataaatcaaaaaggttccaagttcctgagatccattgagcctttcaaaaaaacgtgggaaaagaaaaatgataagaacagttaaagacgtaagcaccaggtactgatcaccaagcgtaccggtcagcaggggatgagaaaaaatgcttttaaaataaccagaaaccttcatacttaccgcaacaagtgcgaaagcagcaccggcattaaaagctatatcctttaaggaaatatccttccgtttccaatagctttcagcactgtttccgctgtttccatcggcttttaccttctcttcaaacggcatggcataatgccgctgaaaccatttgagtgcaggaatgctgattaaaataaaaaacaaaagcgccatcataaaattatcagccacaacggtagccgacacatattcaccaggcgtctcaaattttgccgccatcgccgcaaagttgaccccgccgccgatataagaggcgctgatcatcccgccgattttatcgagatagggaatatgctgtttaagtagaaaaaaagcaagaatgctcccaagcacagtgccagcggagctaatcagaaaaataaacagcaaacgcctgctttccttaaaaatttgccgaacattgatctgaaacaataaaagtggtatcgccagcggcaccacataagaccacacagtatcatacacaggcgactcaacaggaagcactcctacatttgtaaacaccatagcacctgccagcgcgataatagcacccgacacagcggacgcccacttaaagcgctgctccagcccgatgctcactgccgcccacaccgcaataaacccccacaatacccatacatcatcagaagaaatcaaagaatgcaaaatcccatcacccctattgttagaaaattaagacatattataatagccggggaacggaacagcaagtccaaaaaaagtttttctaaaaaagcagttgacgaatagaagggaaggttatataatagaacttgtcagaaagacaataacatacccagcaacacatacatatcatgattccgtagctcagctgggagagcgctaccttgacagggtagaggtcgctggttcgagcccagtcggaatcatagcttaaacccttgcgcagcaagggttttttattttgcttatttattgattttgtctcattcatcgaattggggacgaaattatttttttgagctgattttgacgaagaatctcaaaatcaactctgtttttgtgctaggtttctaggatcgaactggttaaagtgttttactgtgctattttcgagtttctcggtaacgtggccataaatatcactagttgttcgagcactggcatgtccagctcttctttggatagcaactgagactttcgccagcttccataaggagagccaccatagtatgccgcaagtcatgaagacgaacatcttttaggccgtacttcttttttaattttagtccattttgcggtaggggttgtatagtagtaaggttttcctttaccactgtgaaatacaaattgatgttctccgccttcccaggcatcgccaagcaacaatttttccacttgttgcctaaaaagacaatcaaacgcttaagtaattatatcttcaatatccaattatctattctatcgcctctttccatattaaaatcaactctaaaaactcatcagtttctataatactttcaaaaggctcatcaacccggtaatgatgttcagctattgtcttgtttttcttaattattatacttgtagcattcaacgtaatttcaaagtcttcataatctcctgttaaaaccttcttaacgtatccaatatactcgtctgcttcctcttttgttgaaatatcctcaaaaacgtccgagaaaatagttaatttttccggtagtattattcttgtgataccaaatggatctttttttaattgatatgtatatctcatcttgtttatcaccttctatgttatttattatacaaaggataagcagtggctattgtaccatccttgtttaagaacatttctattttaattcctgttgaattttcacctataaacttattagcacctatcttttttttattttgatacgcttcatcaatagcctttaacacatctacacgattccattcctttggaaaaaaactagatttggctatttttctcttcccgcttatttcaacattggcttcataaacaccatttttatcaggtgttttctcggaaccaggtataatttttccacccatcatactttcatgatgatatccaactgctttaccgcgtctattaatttcaccatggtaaatgtgtttcatcgttcccgtattatatttacccgtatccttattgttagaacgttcagatcttctgagaacactctcttttttattttcaatcatactttttaggagaggagtattttttgcgttatacgtattctcgatgtcttgtgcaatcccaaccagtgcaagatcattcttatttctaataatagaattgatgtaagatttgcctttgtttattcctttattgacatgagcagcggctgttccaccttcaaccactttacctactttagaaagcttggtagtggtttgcaccgcggcacccgcaccttttggaccaacgatatttccgatcacataactgatataatgacctttttcatatgcatcaccatttaccattttatcattccatgaatcggcgaggtttgtccagatgatttttgaataagaaggtacgctcaaaatggttgtaattgtttttgtcagtttcagttcgatagggagctgtgaatattcccatgcgcccacagctaagtctttgatgccatatatggtatcgtcaatcacatcgtcaataccatcatcaactccctcaacgaaatcaattactgtcttgctggcattgattatacttttaccgacggccttcagctgttttgcttgttcaagctgcactgcgtattggagctgttcaggggtaagattctcatagccgaccttcttggcaatgtctaagtattcatctggatccgtcactccgtcagctagcttctttttcagctctttgatttctcgttctttcgcttcatctttcttgatcttcaaataagcttcagtctgtttctcgatatcgccttttttcttatgtatgtcactttcacggtacgccttggcgttgtagtgaatgggcgtagcgtttttcccttttcctgtggattcctcaagcttttgaaagtccttcttgatgaattgctcgtttggctctgattgggcatattcagtaacaagtgcttcgtccacgctgcctagtttatcgactgtttttttgcgtttgtcctctgcatctgcaagttcgtctttaaagtcttctgtcgagaacaaatcaagtgggaggatgtcatcgatatcatgtaagatatctttcaacgctttcttttgttcagacattatggattttgattttgtgtaggcgttagccagttcgtgttctaagaaggattcttctatatatgcatcagacaagctggcgtcctctaaagtgcctgaaatgcttgttaagaaagcaattttcatatcaagtaagtcaatccaattgtcagctacacctgcgtggtcttgataaaatgctttaatgttgtcggcgcctttgccggaaaactcactgtcatctaaatcagctacagctttaaaggctttctttagattgaccatctgacttcttaattctttgtattcctttgcacgtttatctgcttctgaaagcagtgatttggcttcaaatactttcatgttcatatcctttcgtttgaatagctccaacaagattttaccatgggaaaatgaagaaatagacagcgatgtgattcaaaagtgtgaaatgaataatttgatctgtgtcaatttacctatttggattatttgtttggaaactgatgacgcagtaagacgattccagctgatgaatggtttaaatcctgatggcatttatggtcctaagactaaagctaaactcgaatctcttcttaaataaaaatagccctcctcaattggagggctatttttatttaatagaaacgtgatgtgtgtaccagtttccggttgcagtgaatcgtaattccatatggccgtggcggttacctccatactttacaaacgtgtaatcagaattggcgattgcatccttagccgttttatcaatgtttgcaattttcttggaagtgattttaccattccagccagcaaaacctgaagcggatgcacttggcgggctttcccactttgttattttctttccatactcgtatgaatagttgtcacttactcgaatatcatataattttatccctgtaaactttacagcgtaatagccacttgcagttttattttgggtggcctgtgtttttatcttttccattcccatatctgtacttacgcccatttccacagtgaaaccattaccgagatcaatttcttgatatggatgatctttgctgacatgcatactgtttaaagccttattcacttcttttacagttgggattttctcagatgaaagggttctcaagtttttttgttttgttatctcgtgaaaggtcgccttatcaataatcagatcagaattcttgtccactttttcaacagcatctgcactttgaagactaaacagagatgaaaaactcaaagctagggcaaaaaccacacccacaagtaactttttcattttatccctccttaatgttttcgtccccatcttatcttaatgtataatattggtaaatgagacgaaagtaacaaatgatgctattgattaaagtattaggctttgaaggaacgggaagatcgaaaagtaaatgaatggttttacccatttaaacaaccatatatcaggtgtatattggattgtaggggagggatatcatggtcaagatcatattggcatttgtttatctatttggcttcgttgtgttgagcaattgggctttcgacggaatattttcagagagctatttctcgccaatcggtttcctttggtctatcttatttacatttttcataggggtttataccggcttgcctttaatctacaaaaagtttactcaatcaagccgtttgactttgaaaagtaaaaagccaatttatttcactatcggtacagctgttattctctttgggctttattttctcaaaaacgaaatcgccccctatttgatgctatgtggctattttttaactctggcatcaggtatagccctgaccatcttattacagcccaaaaccaacaactgtaaaacagtataactaacaagaactaatgaaagcccgtctcaaggcgggctctatatcaaaagaaagggaatttttttgtgatatctatttacaatggtcaatagatattgtataattaaggtatagaaaggaggtgctgaagtggacgaggtaagaaactggattcttgctatcgctggtatcgtgaccatcattaaacacatctacgacatatggcagaaggaaagcgaaaagcatagcaagaaaaagaaaaagcgctcccgccgggtaagcaagaagcgctgatacacagtgagcaaaggggagtaaatccccttgctcataccattatatcacgtccacgataatatgaaaaaatattttaagcagtacaacacagcagattttgccgttttgcttatattggttgccgggatcgtcgcaattgatttgaccgatgagggtatgtctggaaagattgcgcatactgtattgatgatagccgttgttattaccttgttaaaaggattcattatgatgtggagagaaagccgacatgaaagaaagcgaaaaaattaagtttatccaggaagaagttttgactgcagcggaagcgggggagttgcttggaatcactcggcagcgattaagcacccttgtgacttcaggaaagctcaaaccggttaaaaaggttgggacagttgcattgtttttgcttggacatgtacaagcccttaaaaaagaattagaagcaggccggaagaagtaccggccgtatgatgagtgaatcccttctcaagatgagaatgattacttgtcctacttttgccacttaataatgagtggtaaattttatcaatttttgatatcctgtaattaatcataattgcgggggttcattatgaatgtatctgaattagttatttttccagatttattaaagttaccaaaaagcgatttggaggacatttgcaccaacgaaggtattgcggaatctggaggggcttttgaactagcgaaaagaatatgggattatgctgatacgtcagaaaaaaaaacaaagaatgtttacaccgtattgtcacaaattttttgctggtaatacgtcaatttcttggtacacttgtgatagccttgaagatttaagtaaatatattattgaaaaagaaaggcacaatccatttgaaacaaaaattccgtatgaagaggcaaagctaaatacgactccaaagttaagaagtgcatctagaataaacgagcattcatattttttaaggtttatatataaagatggtactcgtaggattataggtgaagatatagaggttttaccgacaaataaaacggctacagcttttatagatgaactaaacggaattatagaagttagagctaaaccaaatgatgctgaaaaaatagcagaggtaattgctgggtatgcaaggcagcaactgtctttacacaagcaaaactttattaaacctttcgggggtagtatagaaagtatagcggataccctaggtggtaaactttacgagtccaaagcaagtcctgagttatggatggacaactttggggaagaagaaaatgaagcattgcttgatatttttgaagctttaagtaaatactttgagaacggagatatagataaacttcaagaatgtttagataatgctaaagagattttgggtggggagctacttagtttaccttttgctgtacttgtacttgctggtatggggaatgtaggtttaaaagttgaacaaaaagatttaaggaacactactttatacaaagtatttaaaccctacttacaaacctcgggtggatatattaaatttgaagttgaggaaaatggtgttcagcacgagttttcaatggttgttggagttgaaagccagagcatctattttcgctctaaaaagactacagaaactgtaataaaaaaggtaagagaaaaacttttattgcaaaaattagttgtgtaaatatttgaaagagggtgatcttatgggtataaattggaaacaaaaatcagaaattgacgaagtgattaaagaaatcgcttgttcaagagtaattagattttatccaacatatattagtaagatcactttaattaatttagatactgtttttgaatatttattggagttggtagatgacggatctctaaatatattgtgggaaataagatgtcctgactttgattgtaactctgtaattttgcgaacacataatttatcagaaataatgggtaaagaaatagaatgtgattattgtgaaaatggtctattagtcagaagacaacatgtattccctgtttttgaaataaatgatgactttagagaatttttaaaacaaagtaaaaaaaaacaagtgaattatctacacgctctataagttcaccaattctccaagaaaaagcattaatttctttagaagacattaatttattactagaagaccgaactaaaaaagaattgaatgaaaaatctggagtgaatatatataattttttatacgttgagggtgattatgtggagaagaaacaatctttgggtagcgtaaaaattggcggaaatgtagggaattttgcaatccaaaatgaaaacacaacacaaactaatggtaataatgaagtaagcagagcatttgatgaaatttttgaacgaataaagggaatcgagaacgatgttcaaagggaacaggccatttttaatgctgaaatattaaggaatgcagttgaagagaacgatgtagataaaggaaaaagagtattagaatttttaagaaattcaattgggacaattggatcgttaacgaccattgctaagttctttggtattactatataaataaggcccaaaagggctttttttatattatccactttttctgttgcttcttcaattcacctttcatcaaaaggctttttacagctatacgaatatcctcttcactctttcctgttttccttttcaaatcgtccagagttggattctttccatacaaatgcatattcactatgatctgatatactttccgttcaaaatcagtcatttgatcatctcctagaaggatgataatcgaacgtatgttcccttgtaaataagttggatttggggacagatggggacgaattggggaccaacttgttcatttttagtcaaaacagaagattttttatcagaaatacttgtcagaaaaccccataaaataagatttcgaaataaaacatccgttcgtgtcagaacataatcactaccttgacagggtagaggtcgctggttcgagcccagtcggaatcatagcttaaacccttgcgcagcaagggttttttattttgcgttaataaagccggttcgtcaaattcgtgagttgttggcgaactgttggcgaaattcattgaccgcagtccaaaaactacctccaaacttacttgattagttcaatagtaacaaacggaagatcggatttctgttaaatcttcattgagaatagccagtccaagaccgtcacttcagccatgcatcttttaaatgaaattttgtactgaaaacatcaattgtatttttaaattctgctctagaatcagcccctttataataatcttgataaattgcttggggtgatactgattcgtgatttgtgctatggtttgcaaggcttgtagcaaaagcaggagcaacagaaacgagtaaagcaagggataatgcagaaccagttaaagctgttttcaatttcattttaagcacttccttttttaaaatacaactttattattaaatggaatacaaaaatatccaaggtgttttttgttagtaagttgagttagggggattggatggcacttagaatattgtttctgctgatgggatgttgattctggatatatttccaacacgattacaggccggacatgaaagcgaaccttgctttgatcggggcaatcatttcatttaaagctgcggtttactttaaagatattgatgtattgagagaagaggaaaacaaatgaacggaatttctgagcgttggaacgcgtttaaattacaaaaatcccctgaaccactctagatcaggggattgctttcccaacagcttattaagtagcggaaggcatgatcaacgatttagtatcaatttattaattgcgaatactagaaacataccgttttccgccttccttagaagtaacatattcccgaggaacgttaagtctattggtagaatgataacttacataaagtttcatatttgctcggctcgttacgatagccgtatgatccatccaaccatcagcatagcgaagacctattttattatggtaatcatagtgatatacatctccaagctttacatttgaatatgtatcagaaacagtcttcatttttattccgccagcttttaaaatgtatgatctaaaggctcctgcattaacccaagcatctgtatagggtttccattctttaaagtacggcattcttccagctcttaatgcttgggaaacaaagttagtacaatctttgtctttataatatttatagtttttatttggttttaaggcatatttttctgcatatttcattgcagcgtaaccactatatcctttaacagatgttgcagtcacagttagttgattagagttagcagcattgaagttcatacttactggtttatcttcacttttcacttcttctttatcatcatttttcacttcttgcttataattttttaaaaattcatctaatttaacatccgaagaatattcttcatcattttcatattgtagagttgaagaagaattatttaattgtgttacatttagttgcttagaagaattactcaatggtattacatttagttgattagaagaatttttaacttgagagaaacttagattagaagtatttgttgattgagaactttgtttattagaagttgttttgggaatttcaagtttaatattatcgcccagagatgttgttactttttcaacaccaaaaacaaagtttcgagtaatataagcttcaacaattagcttattgtttttttcagaagtcttaacatcgtctatatcgtatgtaaactcgtggaatttttgtttgtccactttacttaacgcagaatacagtaagactccttcgtcggaatcagtcaatttagactctttaggatgcgctaaaggagtgttgtgttcaaaatcatatttctgttgttctaacatatccttaactttttcgtaaccaatctcgttggtaattgaaacattttctttagtctctttattagtagtggctgcaaaaacttcatttgttgacactaatggtgacaatgatagacataaaactagtgaagaaagtaattcttttttcatacgaaacctccaataaaatctaaatataagtaatatttatcatttacaccaattgaaatatggcataaaatacatgtaataatataacataaaaataaatacataaaaaggtatcggaggaaaaaatgaaaaagaaaactaaaattatactttctctcttgacagcacttattgttatattgatagtacttccagttctatctcctgttgtctttacagcttcttcggaaaaaggagcaatcagacacgaaatttataaaagaggatatccctaccaaagctactttgcagttctccagaaaagagaaggagacaatgaatctgggaatctttattatgtaaattggctagattggaaagatgaaacagggcaaactcctcacttatgctattcgaaaaaagcatcagatggtgaatacgaagtaagttgtggcacagggccgtaaaaataaattttaaaattgaataagtccaagacggaaagcctgcagacactgatcgttttacagagaaatttgtgcttcgatcggtgtccgtttttttttcgcaactaaccatatgtctatcgcgattactagctatgaaaggagtaattagacatgaaacagtccaaaaagaaaccatcatagaagcaacatgagcgcttagatcgtttctggcaacaaatgatgaacactaacatgcaaacactcagacgtggcaaaggcggcgcaccacagaagaatcaaaacgctgtgactcacggctttttctctaaattcctgccagaagaaacgcttgagatcatggaagagattcaggagcgttcgcctgctgatatgatatgggatcagatacagattcagtatgcagctattatccgggcgcaaaagatcatgttcgtttctgataaggaagaaatgatcaaagagctgaaaaagaaaaggtccctcatatctgaggtcagcgaaattgaagatgggcttgtcatttgttttagtacgtggtttcgctacagactttacagtgaaactataccaaacatatttcacaaacttgataaaataacttttaaaccttcctataaaatgaaggttttttatttgatttcaatttttaaatcctttacatacagcgattgattaactcgagcaatcaatgtcgcagttatatttatttttcaagaaaatgttataatgaaaagccataaaatgataggagggggaatttcgatgcattacataacggcatgtttaaaaatcatcagtgataaagaccttaatgagataatgaaggaattcaaaaaacttgaggaagaaacgaacaaagaagagggttgtattacattccatgcttatccgcttgagccatcagaacgtaaaataatgctttgggagatttgggaaaacgaagaagctgtgaaaacccatttcacgaaaaaacacacaatagacgttcaaaaacaagaattaacggaagtagaatggttaatgaaaagcaatgtgaatgattgaaaggctctttaaaaaaaagacattcaatgacttagaatcagccacttgtgattaagtagtaaattgttgtccaactcttatttttttctatttaatattttttgagacgaaaatgttttttaaagctgattttaaaatgtattcaaagtcagctctgtttgatttaatggattatattctttggataacttgttaccatcataatggagatactccgtataaattggaggttaaaataatgagtcattctcaagaaaaaattgcactaattacaggagcaagcagtcaaggggatattggtacggctatttgtcgtaagttagcctcacagggtatacatatcttctttactcactggaattctgatgcggcctggatagaagaatttcaacaagaaattttacgtatgggtgtccgctgtgaggcaatgaaaattgatttatcagatgcacatgctgcattcacaatacatgaaaaaatttcagataaattaggatatccttccatccttattaataatgcagctcattccgcaagtgataattatgtatcgttagatgctaaatcacttgatgagcattatgcggttaatatgagatcgaattttcttctttgtgttgaattcgcccgtcggtttaaaaaatctaatttaatatcaggaagaatcatcaatatgacatcagggcaggatttaggtcctttgcctggagagttagcgtatgcagcaactaaaggagctatttctgcatttactaggtcgttatcacaagaacttgcaccattgggcatcactgttaacgccgtaaacccaggtccaacagattctacatggatgacagatgaaataagaaattttctttcacctaaatttccaatggggcgtattggcacaccagatgatgcagcacgaatgattgcttttcttgcaagtgatgaggctgaatggataactggacaaattattcattcagaaggtggatttattcggggctaagctactgaaacacaatatacaccaatgtatgatgtattcccaaaactaaatctaaacttgaagcgaaaataaggtcccttctctttttagagggggaccttattttattcatgcatgttttgcatccagaaaatctggcggataaagattaataaaccgttacatatacttttccgaatactgcagtacctttaaacaaagtaatcgtggcttttccttttgatttagccgtcactaaaccattttgatcgacttcagcaactttttggttatcagtccaataacgagtagctgaattatttttaacagaataggtttctccaacttttagaggtaaatcatagtcttgaattttgataacatgtgtaggtgaaatagaaatgttctttacctcagtaggtgtggagtttatttcatgagctgaagctaccccgctgaccgacagagctaacgcagaaatcgataaagcagaaacaacagtttttttgaaattcattttgaaacactcctttaaagttttttgtcttgcactataacaattcaataaaagtaattattttccttgtaaataaatgttaataatatgtgaacgatcaatttatttgagctaagaatattgtgtgccctgcacagagtttgtatttatgatggaaaattgctgagagagaatggccatccttaaaatgttaatagcacacatttgatgggtactagtttgttgagcgtgtgggaattttgttacctgcactttatccccgaagataccaaatcatttttcttcatcatgttcttactttcgtactcatacattagaaaatcttcgttctaaataggtgaagaacattggagtatttttatgaatttctgctgaataacgataaaaaatacattacatagcaaactcaaagaatataaaaatcgcttttttccggatgtttcggtaaaaaacgaaacttttgtctctatgattttattttataatgtaaacggtttcttatatagtatacttatactatcaatttgctcaagtagatactgacaggaaggatagaaaaacagatggaatacataaatacaagacaaaaagagattttgtatctgttgttatctgaacctgatgactatttagttgtgcaagatttcgcagatagggtacagtgttctgaaaaaacaatccggaatgatttgaaagtgattgaggattatctcaatgagcattctcatgcacagcttattcgaaaaccagggttgggcgtttatttacatatagaagaacaggaaaggacctggctaagccaacaattacatactgaacatttttcttctaggcagcggagcgatgaagaaagaatgctgcacattgcttatgacttattaatgaatccgaagcctgtttccgcaaaagacattgccgctcggcattttgtcaatcgatcttccattaaaaaggatttatacgcagtagaagagtggctgaagcgttttgatctcacactggtttctaggcagcggcttggattaaaggttgaagggaacgaaagaaataaaagaaaggcattggcaagaatatctgatttgatccacaatacagcgtttaccagccaatttattaaaagtaagtttttacattatgaagtagactttgtgacgaaagaaatcaaatcattgcaaaaaaagcattccctctatttcacagacgaaacgtttgaaagtttgctgctgcatacattgttaatggtccgccgcatcaaaatgaagcagccgatttcattgtccccaaaagaaatggcggcagtaaaaaagaagaaagaatatcaatggacatttgcttgtttacaacggctcgaaccggtttttgcaatccgctttcctgaagaagaagccgtgtacttaacattacatatattgggcggtaaagttcgttatccattgcaaacagaagagaaccttgaaaatgctgtgcttcctaaggttgtagggcatttaatcaatcgtgtttcagagctgaaaatgatggattttcataaggatcaggatttgatcaatggtttgaacattcatctcaatactgtgctacaacggctgagctacgatctttctgtagcaaatcctatgctcaatgacatcaaaaagatgtacccttatttgttccaccttatcattgatgttttggaagatatcaatcaaacttttgatcttcttattcctgaggaagaggcagcatatttgacattgcattttcaggcagcgatcgaacggatgcagggcagcagcgagacacataaaaaggcgattatcgtctgccacatggggattgggatgtcacaattgctgcggacaaaaattgaacggaaatatcaccaaatcgctgtaatggcttgtattgcaaaggccgatttaaaggattatatcaaaaagcatgaggatattgatcttgtcatatccaccattgcgctggagaatataacggttccccatattgttgtgtctccgcttttagagcctggcgaagagaagaaattaagtgcgtttatatgtcagctgggcgaatcacaccgccaaaaacaaaaaacgtttcagatgctgaacaatacgactccttttttggtttttttgcagcaggaggcagagcaccgctacaagttaatcgaacagctggcgacagctttgtttgagaaaggctatgttgataaggactatgcggttcatgcggtgatgagggaaaaaatgtcggcgacaaatattgggtcaggcattgccattcctcatgcaaacgctaaatttattaaacaatcagcaatcgcgattgccacattaaaggagccgcttgaatggggaaatgaaaaagtttcgctcgtttttatgctggctgtcaaacacgaggatcaaaccatgacaaagcagctgtttagcgagctttcatatcttagcgagcagccggccttcgtccagaagctgacgaaagaagccaatgtcatgacatttttatctcatttggattattaaaagcagggattattccttgcttttttttgttatagggaaaaatgcctttattaccggaacctatggtaaaaaaaagcgattttaatgagctgatttcggtatacagttgagacaagatcttataattcacactttaaaggagggttcctatgaaactgttagcgattacatcttgtccgaatggaatcgcccatacatatatggcagcggaaaatctgcaaaaagctgctgacagactgggcgttagcatcaaagttgagacccagggagggattggtgtcgaaaataagctaaccgaagaggaaattcgcgaagcggaagcaatcattattgctgcagaccgttcggtaaacaaagaccggtttataggcaaaaaactgctgtctgtgggggtacaggacggtatccgcaaaccggaagaattgattcaaaaagctcttaacggggatataccggtctatcgttccgctacaaaatcggaatccggtaatcatcaggagaagaaacaaaatccaatttaccgtcatttaatgaacggcgtttcatttatggttcctttcattgttgtcggcggattattgatagcggttgcattaacgcttggaggggagaaaacacctaaaggcttagttattccggatgattccttctggaaaacgattgaacagatcggcagtgcttcattttcatttatgattccgattttagccggctatatcgcctatagcatcgctgataaaccggggcttgtgccaggtatgatcggcggttatattgcggcgactggaagtttttatgacagcgcaagcggcgccggattcctcggggggattattgccgggtttttggccggatacgctgcactttggatcaaaaaattaaaagttccaaaagccatccagccgattatgccgattattattattccggtgtttgcatcactgattgtaggtttagcgtttgtatttttgataggcgcgcctgtagctcaaattttcgcctctttaacagtttggctggcggggatgaaagggtcgagctcgatccttctggcattgattttaggggcgatgatctcatttgatatgggcggtcctgtaaataaggtggcgtttctgtttggatcggcaatgattggagaaggaaattatgaaattatgggaccaattgctgtcgccatttgtatccccccgattggtcttggcattgcgacgtttttaggaaaaagaaaattcgaggcatctcaaagagaaatggggaaagcggcatttacgatgggtctcttcggcattactgaaggagcgattccatttgcggcgcaggaccctctgcgcgttattccaagtattatggcaggctcaatgacaggttctgtgatagccatgattggcaatgtgggagacagagtggcgcacggcggacctatcgttgcagtgcttggcgcagttgatcatgtcttgatgttttttattgctgtgattgcagggtctcttgtcactgctctgttcgtcaatgtactaaaaaaggatattacggcgtctcctgtgctcagtgaaactgcaccgacctccgcgccaagtgaagctgcggcagcaaatgaaataaagcagccaattcaaagccaaaaagctgagatgtcggaatttaaaaaactgacagacattatcagcccggaattaattgaaccaaatttatctggggaaacgagggatgacatcatagatgaattgattcagaaattgtcccgaagaggtgcgctgctttcagagagcgggtttaaacaagccattttgaatcgtgaacaacagggaacaacggcgattggcatgaatatcgcgattccgcacggaaagtctgaggcggtcagggagccgagtgttgcctttgggatcaaacgatcaggcgttgattggaatagcctggatggatcagaagctaaattaatctttatgattgctgtaccgaaagagagcgggggaaaccagcatctcaaaatactgcagatgctatctcgaaagctaatggatgacaattatagggagcggctgctctccgtgcaaacaacagaagaagcatacaagctgctagaagaaatcgaataaagcgggggattttcatgacgactgaaccgttatttttcaagcctgttttcaaagaaagaatttggggcgggaccgctttagctgattttggctataccattccgtcacaacgaacaggggagtgctgggcttttgccgcgcatcaaaatggtcaaagcgttgttcaaaacggaatgtataaggggttcacgctcagcgaattatgggaacatcacagacatttattcggacagcttgaaggggaccgtttccctctgcttacaaaaatattagatgctgaccaggacttatctgttcaggtgcatccgaatgatgaatatgccaacatacatgaaaacggtgagcttggaaaaacagaatgctggtacattattgattgccaaaaagatgccgagattatttatggccacaatgcaacaacaaaggaagaactaactaccatgatagagcgtggagaatgggatgagctcttgcgccgtgtaaaggtaaagccgggggattttttctatgtgccaagcggtactgttcatgcgattggaaaaggaattcttgctttggagacgcagcagaactcagacacaacctacagattatatgattatgaccgaaaagatgcagaaggcaagctgcgcgagcttcatctgaaaaagagcatcgaagtgatagaggtcccgtctattccagaacggcatacagttcaccatgaacaaattgaggatttgcttacaacgacattggttgaatgcgcttacttttcggtggggaaatggaacttatcaggatcagcaagcttaaagcagcaaaaaccattccttcttatcagtgtgattgaaggggagggccgtatgatctctggtgagtatgtctatcctttcaaaaaaggagatcatatgttgctgccttacggtcttggagaatttaaactcgaaggatatgcagaatgtatcgtctcccatctgtaacatagcagggcttgagaaataaatttgcgagtgaagacgcctattctgcagcaatgatctaaataaaataagagtttaatagttggagaagaaatgttacactcttttctgtatatggtaaagaatgaaaaaacacgattcggttggtagtccggatgcatgattgagaatgtcagtaaccttcccctcctcgggatgtccatcattctttaatatcttttatgaggagggaatcgttatgaaattaacgatttactacgatgatcagttttgggtaggcgttgttgaagttgtggacaatggaaagctaagagcctttcggcatctttttggcaaagagccgagggattctgaagtattagagtttgttcataaccaactcctgaatatgttggcccaagctgagcaggaaggagttcgtttacaaggcagacgtcaaaaaaagatcaatccaaaaagattgcagcgccaggtttcaaaagagttgaaaaacgccggagtagcttctaaagctcaagaggcgataaagctagagcttgaagcaagaaagcaaaagaaaaaacaaataatgaaagaacaacgagaacatgtaaaagagcaaaggtatatgctcaaaaagcaaaaagcgaaaaagaagcacagaggtaaataatccaaacaaaagcaggcgcagtgcctgcttttgtaattaaggactctactttgtaacatatatccaatgtttatactccgctgatttatgattcaatataaaccctaacttctccaaggttttttgtgagcctagattatcatgttcgcatcttgcggtgatccgggatactgtttctcggcttaatgcccagtttattagtttttgggcggcttccacacaataacctttgcggcgatgacttttatttgttgcaaaaccgatttcaatcatgccattttcgtctgggtcacctaaaaatccagttcctccaacaatttcatgactgtccttctttacaataatccatgaatcaaatccttttgttccattgtttttgactaaaatctcgcggaaataaggtatcgcttcaaaaaaatcagaatttggccattcaccatttgtttcataacctaagtctttgatagcctgatgatcttgtttagacgcggcgtcaagaaggggaatatcaatcgtttttaatcgtaatcgattcgtttcaaggagaaccatatatctaatcctcttttctttttactgggaataatgataacatataacaattttctctgataccttggcagtagagaaagatggaaaaattgagggggattgaaagagtgacaggggagagtttgcccagaccaaaaacgggtaggaaaatgctgatgttaatgtgtccctacccgtttttctgttcctgaatgcagggtttctgataacatgttgtgctaccttttcgcaatcaaataaagcgatatggctctttgggtttgaacaggattatgaatgataatgacccattggtttcttcgtcttggaaagcttgctaccgcatacaatggagcagtatcgcgcggagtgaacccaccatttatcacgttgatatctcttccttcaagatgacaaactaagtattcacctggattgatgacctgttggttcgtccatgcgtaagaataaaagccgtctccaagatcttcggtggaagatggggggacaaagccatctacagtcaatgtgatttctcttcttcgctgtctttctgaaaaatctggacttctttgagggttatgagtatgtgaaaagtaaggaattaacgcagggccataaaagtaatgatacaaagcaaccactcctttattttccattcatacaaattgtatgtgggagttatttgttcattcctgttttgttccatgtagactaataatgggctataggcgtccaaggaaatcaatttgtcctttcgttgattcaatgctagtaaccttgaaaatgcaggttaggatgatagaatttacttattactgcaagaagttagatatacatcattttgatagtgggtgaaaacaatggcgaaaaaaatggcaaaaacaaatgcggttcgtctgatagaacagcagaacatctcttatgaggtattagggtataaaacagacggccagccggtagatggcatctctgttgcggaaaaaatcggttatcctttgaaatatgtatataaaacgttggttgcagcaacaggaacaaatcattattatgtctttgttgtacccgttgcagaagagttagatgtaaaaaaggcagcaaaggtgacaggggaaaagaaaatagaaatgattgcaatgaaggagctgttagcggtaactggctatcttcgcggcggctgctcgccaattggcatgaaaaaattgttcccgacctatattgatgcatctgcagaaatgcttgattttattattgtcagtgcagggaaaatcggtatgcagctaaagttggcgccacaagatttagccagatcatgtgatgccgcatttgcagaaattgtatagatgcagatataggggaacgaaaaagcttagtcatatcgactaagctttttccgcatccctttcaaatatgatttcaaaataagcagctgccccatacccatctatactgggagcgaaaatctgaacgaatctccagcctcttttcgcataatcatggatgatttgctggtagtcttctttaggccttcttctcatcgtactcagctcaactcttacgaattcatattctttcatcgtttgatccctcctattaaggtatacgtaaaatggagcgagaagttccgaaaagcctcactaaacacagaaacatcttgaagagttaaggggctataaaaacgaatttcaccgggtcagcagtccaaatgaatctcttgcttattgcatttgactgagtatataagtaaaaaaagagcggtcagaacatataagaaggagatgatcattaacgcactcataacagggtagtgtttagcggagtagatgaaaaaatcaagctgtgaaatttgtttggggctgctgacggcatcaattccatttagcagttttgagagtttagcagtatagttccaatcaaatcgatctgaaacaagctcgcttccttgataccaattaacagcagctaaaaacagaaataccataatagaaaatccaagctgaacaactaaaaatattcccttcacttttgtatgacctccaaatctatgaatatgggaaaatcaaacaatatattaccaccgtatgggttattcttgcaatttcactttcatacaactcaaacgcaagtctatttttttgtttgtttttggcttataatacctgatgatggaaaaagagtgcgggtttatagattagagaaacaaatgtatttcttagcattttttatttgtggagagagtatagaagcattcgattagatctgctttttcacagaaacgcttttcatctgtttgcctgagctttacaattctggcaaaaaaacaatgatttctttcaatcaaaacatgcaacgatgcgacatattttatatcttgatgacttatctcattgcctttaagtcattctatcgagaaagtgatggtattttatgaacaaagaaaccctaaaaaacatactcatgattttttcaatatgcgcaaccctccgagaaaccgatggtatgcgcatagctgatagctggattttgagtgagattatacgatttttgatttgcatggctgtgttttttgccatgacatttctattagatgctgtttttccaaacaaaaaagagtcacattaatgtgtggctctttttgcatcatctgatcagaaacatcataaatgaatcgatcatcatgatgaagaacagcaagcaaaaataaataagcgagtagacaaacatatcctttgcccacttcacgtcatcgtctgttttgaatcctttgatgctttttttgatccatatgcctccgagaaccaaggcggctaagaaataaaatgggcttatatggccggtgcctagagagaaaggaaataatagcgtgaccggcaccaggacggcaatatattgcatcatttttatttttgttacatgattgcctttgactactggcaagagcggaacgccagcagcgcgatattcctctttgcgtcttatcccaatcgcccaaaaatgcggcggctgccacagaaacataatcgtgtacaacagcactgctgtcatactgaagtcaccggttacggcacaataccccatcaatggcggcgcagctcctgggaagctcccgacaaatgtgctccacacagacgttcgtttcacccataccgtatagatgatcgcataaaaaataaaggcggccagtccgagataggccgttaatggattgagggaataaagcatggcaaggcctgcgatccctaaaacagagccatatgttaagatcatggctggcggcattttccctgtgaccgaggccctgctgcgagtgcgtgccatttttgcgtccatatgccgatcaaaatagttgttatagacagtgccggaagccatcacaaacgcggttcccaacattgctgttaccattgtcatcaaaaaagccaagccggttaacgttttttctgcgcttgcaaacgcgatccaaaacccgccgaaggctgctatcgagtttgatatgataatgcccggctttgcaagtttgataaaatcgtaaatggttacccggttcgaagcttttatgtattttgtttcagatatggctgcagaatctcttgtattctccaaaaatagacgcctcccccaaaactgcatgcttttgttatcgtaacaagagggggacagaatcacaattatttcctatatttgtcatgatattgtcatttttaaaacaaaaaaatggggagctggactgcccccattttgatatgcggcgactagtaaccgtaacctccgccatatcctccgccataaccgccgccgtaaccgtgccaagggtagtaaggcggtcgcgggcgcgggtagtaataaggcgggcgcggataaaacgggtagaacggataatacggtcttggataataataaggcggataaaatggcggtctcggacgcggataataataaggctgtctttcatcataaggggtaatttgttcaaatgactgttcattcaaagggtaatccaagaggaaaacctccctagctttttttattccttttaccatattcctgatgcttaagttgggtgtatgtacattcatgaaattcggttttttttatgatgaaattccttaaaaaggattgacatgaacttctaaatctcatagtattacaaatgtgaaataaatgttactacaatgttacaaaaacatttctaaatagatacagttccaactgatgaagagtaaatcgaaatggctacgaaagaaggagtttttgttgttggcaaaaagaatcaaatggtttcatgtattaatagcagttgtatgtgtggtgggccttatcggctttttccataatcattcattgaaaaaagaaacggtcatgaataaagtaagaactgattctcaatatgggaatgttgagatcgcaacgcttgtgaatgacgggaaaacttttaattacgcggttaactatcccgttttcaaaaatgaaaaaatggattcggcattaaaaagattcgcagaaaaagaggttcgtcaatttcaaaaggaaacaaaagacgttgaccaagagcatacgacaaaacgcaacgaattaaatgttgattataaaattgtccattatgccaaacagacagtggcgattgtatttaatgaatataaatacatcggcggggcacacgggcaaaccgtgaaaaaaacgtttaactatgattttagtaaacaagcgtttctttccattgatgatattttcaaagaggacgctgactacttacataagctttcgttaatcgcttatcacgagctgaaaaagaataaggacattgccgcggacgatgcactgttaaaggaagggacggctccgaaaaaagaaaatttcagccgctttgccatcaaggaggattatatcgaactttactttgacacatatcaggttgcagcaggctatcttggagagcaatcgattgccattaagaaaagtcttttgaaagacattctgaaagaacaatatattgataaagcaaaaaataaaaataaaatcaaagaacaaaagccgaagcatgaagtgatttctttacccaaagaggaaacggttgatccaaatcaaaaagtcattgcgcttactttcgacgacggcccgaatcctgcgacaacaaatcagattctagactccttgaagaaatataagggtcatgccacgttttttgttttggggagcagggttcaatattatccggaaacgctaataagaatgctgaaagaaggaaatgaggtggggaaccattcatggagccatccgcttctcacaaggctttcagtgaaagaagcgttaaagcagatcaatgatacgcaagacatcattgaaaaaataagcggataccgtccgacgcttgtaagacccccatacggcggcattaatgatgaactgcggagtcaaatgaaaatggatgttgcgttatgggatgttgacccggaagattggaaagaccgtaacaaaaaaacaattgttgaccgtgtcatgaatcaggcgggagatggaagaaccattttgattcacgatatttaccgcacctctgctgatgcggccgatgaaattatgaaaaagctcaccgatcaaggctatcaattggtgacagtttctcagcttgaagaggttaaaaaacaaagagaagcgaaataaattaaaaaaggctgtccgtacggacagccttttttctatttaataagagcctgtggtggcccaaacatttaagtttggtcctgaatacttgccaaaagcgtaagaagtccttggatctaaatcatataccatcggtgtatagcaagacttttggccggccaccgcttttccattgccgcctgcagaatcacaattatatctctttccgtccgtgtttcgggtaatctccgcatttgcttcaaagccagacgtcaatgtattattcatcgtgatttttgcccaagccgttttacatgtactgctgaatttaagctcgactactccgatgacttgattgctggcattcactaagtttgaggatttttttgtagagccgctggacgcacaatcattgtaataagggctttttccatcgtaggcatgggtttccgcattggcgggtacacctttgacggcaaaaacaaatactactgcaaataacaccaatgaagccttcgtaaacagtcttttcatatcctttatgacctccttaatatggcaaacaataaatcatacggaggaacaatcaaaacatgcatgcttttttgtgaacaataaaggcggccgggaggatggagttcttggccgcctttgatgtgaggttaaacttttacatcaatggtttgtccgagagtcggatgctgaatcatctttaaggtttgatcggcattttgctgggcggtatccagcatttttttcgttaaagcgatattaacattctgggcaagggatgcttgatgcattgcaaccgataaagcaggaatatccatcgttccacctcctatgccttacctatcggcggctttgtatcattttacagtgaaaaatggcttaattttcgctgttgacccctacgctgcggcatatcgtatgtttttgacaaggagggaatcaggatgaatcttgtcatggaaaagacctttgagcaatacgaaaagctgttttcaatggaagaacagaaaagagaagatgaatttcggtatacgatgatgaggccgtttgaaaagatgtggaccgccatccatgttccgctgaaagcgaaggagccaaacggctatgatgtgatcatggctgcgaaaatgcttggctatttggatgtccgtgatgttgaaatcggacagaaagcactgcgaatactgaaagaatcacatgtttcagagactgcggaatctgcacttcggcaatgcatattttttgatgagcgcgaacagctgcgggtgaatgcaaaggagatcaaattcggcctttatatcgctgatccaaataagcttcagctgcaaaaaggctactgcgggtttggcgggataccgggctttattcatgtatggattgatccgaaccgttataacctgccaaggattccttccattattgctcatgagtttcatcataatttgcggttttcgtatatagattttcatcatggctctgtaagtgtcggggattatcttgtgattgaaggattggcggaatcattcgccagagagctgtttggtacggaacgattgggcccttgggtaactcgttttgatcatgaggatttgcaatattccattgatgtgattaatgaggtgttggatgtgaaaggattttcggaagtcagccgttatatgtttggtgatccaattgctaaagacaaaggatttgaacctgtaggtttatcggcttttgcgggttatgcagttggctatcatgccgttcagtcatttatgaatcaacatcatatcacgataagcgaggccacacgtttggatgcgaaggccattctttctcagtgcggattgttttccaaatgaaaaaaagcgtcacatacagcggcgctttttgattcccaaaaccagcagttctatggcggcacaggcggcaattccgattgtatatgcttcgatatcgctccataaaaaaccgtaccctagtacaagcccgccaagagaagtatctctaatctggtcgatccattcggcatgatagagctggctgaattcaatgacaaaacagaaagaaagactgataatgcccgttatcattgtcttcagcttccgaaatagaaatccgcatcccgtgaagatcatggcggcccacaacgagtctcccagataagtattgagggtatcaggaagaacactggagaatgctctggatccaagccccagcccaatgatcagtatggtgaaaactgcatatatccaacgatttcgcttcattgcgaattgataccccgtctctgcttcatctccctgtattgtaaggaatatagcttttatttgtccactaaaaaagcggctgaatagccgcgtagggtgtttattttgcttttaggtttacatggtcggctgtctgatccgtgcctattacaaaatggagttcatagcggcctgtatcatatacataatcgatttcatcggtaaacgggacggttaacacccgatttgctggtcctaattgcttctgcagcacttccggcgtaactccgcctaaattcagctgccgttccacaccggttccaaagtatcggatttctgaaattgtcatgtctttatgataggaaaatccgtagcccggctgtcccatattccagtgatataaatcaaatcgattgtctcccccgactggtctttccggttccccaaacgcagcgtggacatccccttttgtgcttttgttaatggtaaggccttgcgcctgctgaggcatttctcctttgtaggcggtgttgtaaaggtttttgacgagctcggaggctgattgggttgtattttcatagagtgtatttgtttgagctgcggcctttgccggtgctgaaaaggacgcagccccaaagccggtaaaacagcttgttactgctgctgccgcggttatagcagacattgtctttttcatgttaatccctcctaattgatctaccattccgtttccccgtgtttttgcaacgaaacatgtgagtgcgctttgtatgttttattgagttgttgtaagggaactgaaataggtaattcggtatataaagcaagaaaggggaatggagatgcctggcaagaaaaaaatcacaataaacggcgttgaaatggaagcgtccgaggaacagacggtgctgcagcttttgaataacagctcgattgaagtgccgcaagtttgctatcatccaagcttagggccgattgagacatgtgatacgtgcatcgtcagcatcaatggtgagctgaagaggtcgtgctccgctgaattaaaggatggggatatcattgatacgctctcacctgacgtgaaaaaagcgcaggtcatcgggatggacaagattttatataatcatgagctttattgtacagtttgcgattacaacaatgggggatgcgaaatacataatacggtgaaggaaatgaaaatcaatcaccaaagcattccgtttgatcacaagccataccataaggatgaatcccatccgttttatcggtatgatccagatcaatgtattttgtgcggacgctgtgttgaggcatgccaggacgttcaggtaactgaaacgctgaccattgactgggagcggaaacgcccgcgcgtcatttgggataacgacgtgccgatcaatgagtcgtcatgtgtgtcatgcggccattgttcaacggtctgtccgtgcaacgcgatgatggaaaaaggaatggaaggggaagccggatatttaacaggcatcaataacgaaacgctgcgaccgatgattgagatcacgaaaggcgtagagacaggctacggctcgattctcgccatttctgatatggaatcggccatgcgtgatgaacgaatcaaaaaaacgaaaaccgtctgcacgtattgcggcgtcggctgcagctttgatgtctggacaaagggcagagacattctgaaagtagagccgcaggaggaagcgccagccaacggcatttctacttgtgtgaaaggcaagttcggctgggatttcgtcaacagcgaagaacgcctgacaaagccgctgatccgggaaggcgatcatttccgtgaagcagagtgggaggaggtgttatcgctgatcgccagcaagttcactgaattaaaagaggcgtttggcccggattctctcgcttttattacatcttctaaatgtacaaatgaagaatcctatcttatgcaaaagctggccagaggggtcattggcacaaataatgtggacaactgctcccgctattgccaatctcctgcgactgccggcctgttccggacagtcggctatggcggtgattcaggatcaattacagatatcgcgcaagcggaccttgttttgattatcggttcgaacacgtctgagtcgcatccagtcttatccactcgcattaaacgggctcataagctgagagggcagaaagtgatcgtcgcggatatcagaaaacacgaaatggcagaacgctccgatttatttgtccagccgcgtgccggatcggatatcgtctggctgaatgcgatcgccaaatatttaatagaaaacggcaaggccgatgaacgatttttgagagaaagagtgaacggacggcatgaatatgtaaaaagcctcgcgccgtacacacttgaatatgctgaggagaaaaccgggattgatcaagaaacccttatccaaatggcagagatgatcgggcaagctgacagtgtgtgcgcattgtgggcgatgggcgtgacacagcatattggaggaagcgacacgagcacggcgatctctaatctgctgcttgtgacaggaaactacggaaaaccgggagcaggttcttacccattgcgcggccataacaacgtgcagggagcaagtgactttgggagtatgcctgacagactaccgggctatgaaaaagtgacggacgaacaagtccgccaaaaatacgagcgggcatggggcgtaccgctgccgaaggagccgggtatgaccaaccacgaaatgattgaaaaaatccattccggacagttgaaagcgatgtatgtaaaaggtgaagaaatgggccttgtcgactccaatatcaatcatgtacacgctgcatatgaaaagcttgatttctttgtggtgcaggacattttcctttcacgtacagcggagtttgctgatgtggttcttcctgcgagcccaagccttgaaaaagaaggaacgtttacaaacacagaacgccggattcagcgtttgtatcaggtatttgaaccgctgggtgaatcaaagccggattggcagattattatggaggttgccaataagcttggcgccgactggctctatgagcatcctgcagacattatggaggaagcagccaagctgtcgccgatttatgccggtgtcacctatgaacgtcttgagggctataattccctgcaatggcctgtaaacgctgatggaaaggattcgcctttactctttacagagcgcttccctttcccggacggcaaggccattctctaccctgtccagtggacagagcctaaggaattcggtgaggaatatgatatccatgtcaacaatgggcggctcttggagcacttccacgaagggaacctgacttacaaatcaaaagggatttcggagaaaacaccggaagtgttcttagaaatttctcctgagcttgcggcagaacgagggattcaggacggaaccctcgtcagactcacatcgcctttcggaaatgtcaaagtgaagtgcctgattactgatcgagtcaaagggaaggaagtatatctgccaatgaacgattcaggggaagcggcgatcaacctgttaacaggcagccatgccgataaggataccgatacgcctgcttacaaagaaacatcggccaagatggaaattttgaagcacgacggaatcagcccgctgcctaagatcaaccaccgcaacggcaatccgcagccgcaaatcggtgtgcaggttcataagaaatgggcgcggaaggattatattttccctggtgacgctgtgaaaagggggatgggccataatggctaaagcgattaaacgaatccaaaaaatcgaggtaacagaagaggatcagcgaaagcgtgatttgcgggaaattgaagatgctctaattgaccacaaagaagcgattctcgaaacattgcatatgctgggccatatgaacgagcgcggtgtcctgccgttgctccgcggcctttttggccaaggggataaagttcttgatatcctggtgaaaaaggcagatacagaggaaacagccaatacgctgaaaaatctgcttcttctgtttggaacactcggcatgctggacgtgaagcagctggagcctctcattttgaaagtgaatgcgggtgtggcaagcgctgtagagcagaaaaacagtgaagaaaagacaggttattttgatattatccgctcgctaaaagacccggaaatcaacaaatcaattacactgctcttttcctttttaaaaggaatgggacaagatacaaaggagctggaacgcacgacgcagcctccggaacaccaaaaacatcatcaggaacctcgagagaaaagaggaatgaataagcgagattgacctcccacccgagcggcttcagccagctcgggttttttgatgaaaaggtctaatggactagtaaaaaatattcaaatactaggaagaagtaagattgtgatgaatgagatagaaataatcgttactttcttacctgttaagaaaaggaaaaatctgattataatagaaatcgattactttagatgggggaacaatcatgaaaaaagtcttattactattatttgtcttgacgatcgggttagcgctttctgcgtgcagccaatcgagcgatgcgtcagagaaggaaaaaccgaaagagaaaaaatcgcaagaagagcttgaaaaggaacttgataaggaattgaaaaaaggcggtgagccgaagaccaaaaaagatgatcaaatacataaaataggagaaacatttaaagcaggacatacgaattttacagtgaataaagttgatagagtgcaaaaaggtgaatatatgaatgttggcggagctgtaaatgaggagacaaaaacaataaaagatgatgaggaacggcttattatagaagttacgatggaaaatataggggaagattcaataagctacaattttatcgggtttgatttaagagataagaatgatcaatcagtgcggcctgttttttctatagaagagaagggcagaatccttatgggaggaacactagtatcggggaaaaaggttacaggtgtactcagttatgtcatccctaaaggagaacagaaacattacacactggtatataatccgtttttagctgatacaaatagcagtaatacagaagagagagtaaaggacgatattgattacttggtgaagttagattagaagctaatttacagttgcacgtttttcatctgtggaaaacgtgcattttttatagcgaaacttgacttgaaaggatgagtgataaaagtgcaaaccaaatggctggaacgggcacagcgaattcgggcgatcgcacaggctgggcttgctttttccaaggatgtgtacgacagggagaggtacgaagagctaatgaagcttagcacggaaatgatggcggattactcggagaaggacattgaagttatcactgatttatggcaaggcgagaagggctatccgacaccgaaagcggatgttcgcggcgcagtattccgagagaatcagattttgcttgtccgggagaagcatgatgagctgtggtcgctgccgggtggattttgcgagattggtttatcgccagctgaaaacgtcgtcaaggagatcaaagaagagtcggggtacgatacagagccgtctcgattgctggccgtgctagacagccataaacactctcatccccctcagccttatcactattataaaatcttcatcgcatgcagcatgacgggcgggcagggggaaacaggggtcgagacgaatcatgccgctttttttccggaagacagactcccgccgctctctcctaaacgaaacacaccctcacagcttagcatgctgtttgactttttgcgccatccggacaagaaaacgatatttgactaaaaaagaaagagcctatgggctctttcttttttataatgtaatgtgtttttcgttggcgagtttcagaagggtcaaaatagaatcggcttgtttatggccgagtttttgctttaatttgttttcttcaactaatcggctgccataaattttgacagaggctttgtcgacgacagtatgccagttttcctgtttttttccctcaacaagcggtttttcatgtctctcagaaaaagagaacacaaacagtacgaatgcaagtgaaagtaggatgccgacaacttgttttttgtaatcagtctgtgctgccacgttgttctctccttcaccttttaccttctatttaatcatagaatcagcttattttacataatgggaaagtcatttttggagttagtgcatttggttgaaaacagaggcgttttttgagcggagcggtgcaattgaatctatattggctttgcgtgcttatgcctaaggtcacgttgtgaaccaaaacagcagtgcagaatagaaaaaaattgaaagattatggtaagatgaacgaaattcgagggggaatatatgatgcctgcatcaaacatcgtgatcgcctgcctgctgttatcaatttaattatttgtggtagtccctctctttttcgaaagcgggaggtgaagtggaacattaattgctgaattctttcaaggggagtgaccgtacatgaatgtgttaaaccgccggcaagccttgcagcgagcgctgctcaatgggaaaaacaaacaggatgcgtatcatccgtttccatggtacgaatcgatgagaaaggatgcgcctgtttcctttgatgaagaaaatcaagtgtggagcgtttttctttatgatgatgtcaaaaaagttgttggggataaagagctgttttccagttacatgccgcagcagacaagctctattggaaattccatcattaacatggacccgccgaagcatacaaaaatccgttcagtcgtgaataaagcctttactccgcgcgtgatgaagcaatgggaaccgagaattcaagaaatcacagatgaactgattcaaaaatgtcaggggcgcagtgagtttgaccttgttcacgatttttcatacccgcttccggttattgtgatatctgagctgctaggagtgccttcagcgcatatggatcagtttaaagcatggtctgatcttctggtcagtacaccgaaggataaaagtgaagaagctgaaaaagcctttttggaagaacgagataagtgtgaggaagaactggctgcgttttttgccggcatcatagaagaaaagcgaaacaaaccggcacaggatattatttctattttagtgaaagcggaagaaacaggcgagaagctgtccggtgaagagctgattccgttttgcacgctgctgctggtggccggaaatgaaaccactacaaacctgatttcaaatgcgatgtacagcatattagaaacgccaggcgtttacgaggaactgcgcagccatcctgaactgatgcctcaggcagtcgaggaagccttacgtttcagagcgcccgccccggttttgagacgcattgccaagcgggatacggaaatcggggggcacctgattaaagaaggtgatatggttttggcgtttgtggcatcggcaaatcgtgatgaagtgaagtttgacaggccgcacatgtttgatatccgccgccatcccaatccgcatattgcgtttggccatggcatccatttttgccttggggctccgcttgcccgtcttgaagcaaatatcgcgttaacgtctttgatttctgcttttcctcaaatggagtgcgtcagtatcactccgattgaaaacagtgtgatatacggattaaagagcttccgtgtgaaaatgtaatagataaggagactggagattcatgaaaaagtaccatatttcgatgatcaatatcccggcgtacggacatgtcaatcctacgcttgctttagtagagaagctttgtgagaaagggcaccgtgtcacgtacgcgacgactgaggagtttgcgcccgctgttcagcaagccggtggagaagcattgatctatcatacatccttgaatattgatcctaagcaaatcagggagatgatggaaaagaatgacgcgcccctcagccttttgaaagaatcactcagcattctgccgcagcttgaggagttatataagggtgatcagcctgatctgatcatctatgactttgttgcgctggctggtaaattgtttgctgaaaagcttaatgttccggtcattaagctctgttcgtcatatgcccaaaatgaatcctttcagttaggaaatgaagacatgctgaagaaaataaaagaagcagaggctgaatttaaagcctacttggagcaagagaagttgccggctgtttcatttgaacagttagctgtgccggaagcattaaatattgtctttatgccgaagtcttttcagattcagcatgagacgttcgatgaccgtttctgttttgtcggcccctctctcggagaacgaaaggaacaagaaggcctgttgattgacaaggatgatcgcccgcttatgctgatttctttgggtacggcgtttaacgcatggccggaattttacaagatgtgcatcaaggcatttcgggattcttcatggcaagtgatcatgtcggttgggaaaacgattgatccagaaagcttggaggatattcctgctaactttactattcgccaaagtgtgccgcagcttgaggtgttagagaaagctgatttgttcatctctcatagcgggatgaacagtacgatggaagcgatgaacgcaggtgtgccgcttgtcgtcattccgcaaatgtatgagcaagagctcactgcaaatcgggttgatgaattaggccttggcgtttatttgccgaaagaggaagtgactgtttccagcctgcaggaagcggttcaggctgtatccagtgatcaagagctgctcacccgcgtcaagaatatgcaaaaggatgtaaaagaagctggcggagcggagcgtgcggcagctgagattgaagcgtttatgaaaaaatccgctgtcccccagtaaaaacataaaaaccgaaatcaatttgatttcggttttctgtttaaatattttttttcatcccgcatctccggcattctctaagaaattttccgccttttacagagcttttgaacagtgtgtaatcacagttgtcgcagcgcccgctgcgggcgtccggatattcattgaattcgtaaacgatcgatgtatcgtagccttttgtttcatattcttctttttttgtttccatgtcgtccctccgttacaagacgtgtctgctgtttatcttacagcaagcttccggcgtattcaatggattttagaggtttgggtttatcttgatttctcccttggtttgcgccaaaatagctttaataagcttgtatacataaaaagcctatgcaaagaggagaggaaacgggtatgggaaaagggttacttggaaaacgtgtggcaatcggtggctcacgaaaaacggaagaaatcagtacaatcattgaaaaacagggcggaatacctgtcatccggcctctccaaggtacagtttacttagcagagaagcaggtggagccggatttgcggacgtttgcggaagaaaaagctgactgggtcattttcacgacaggcatcgggttggagactcttgtcgatatggcagagaaaattggactgaaagatgaatttctgcaggccattcgccaagcgaaagcggcatgccggggatacaaaacgctgtctgcgctgaaaaagcttgggatcacaccggaagcttcggatgaagacgggacaacaagaggcttaatccgttctttggagcctcacgacttttcaggaaaaacagtcatggtgcagcttcatggcgaaaaagcgccggctctcatggcatttcttgaagaaaaaggcgcgtctgtcctgccgattctgccttatcagcacatcccgccggaggaggaaacggtggagcggttatgccgagagctgatgaaccgtgagatcgatgccgtttgttttacaacggccattcaggttcgttccctgtttgattttgccaaggggcgaggttatatcaatgaagtgaagaaggtattcgaagaacgcgccatcgcagctgctgtcggaaaagtgactgctgaagcactgcgggaagagggcattacgagactgcttgcgccagagattgagcggatgggtgcgatgattgttgagctggccaagtattatgaagaaaaggaataacaagtacaaaaagccgcttttccctcggaaagcggcttttgtctgtcattcattctgcttcagctgctgatgaacggtgaataatgatgggtatgtcagcacgcttaagattacacaagtcagcgcggctgaggccatcgttgtaaacacgattaagagttgaaagcgtactgcctgaatcgggtccgcgccggctagaatctggcctgtcatcatgccgggaagctgaacaagacccagtgttttctggctttcgagcgtcgggatcatactcattttcatcgctgaagtaagaatgcgctgtatggattgcttcggtgtgccgccaagtgacaatattaattgaatttcttctttgcgaacgccgacttctgagttaagccggtttagaaacaaacttgagagcaccatcgaatttccgatgaccatcccgctgatcggaatgacatatcgtgccgtaagcggaatgatatgaagagacagcagaattccctgcgtcaccatttctacgattgctaacgcggcaaacaccctccaaaacgaaccgattgtatttttctttcgcttgatgacattttgcgccgccaccgcgagcattaacagcaccatcagcaggataaaaacagggtggtctccgcgaaaaatcagcgacaaaacataaccgatgataagcagctgcaccgcggaccggatggtggcgatgatcatgtctttttctaccccggctttaaaggattttgataaaaacaaggcgatcaaaacaaagatcatcgttaaagagagagaaaggtaatccattaccgagtgcctcccttcaaaaattctttcgctgcttcatgctgcggagcggagaaaaatgtttcggtttcggcgatttcaagcagccggccatctgccataaaccaaatggtatcggctactcgttttgcctgctccatattatgagtgacccacatgactgtccattttttctcttgatgctgacgtttgatcagttcttcaatctcaagagcagaaaccgggtccaaggccgacgtgatttcgtccaacaatagaatggaggaaggatttgagagcgttctggccagtgacagtctttgccgctgcccgcccgataagtctctggcgcttctgtctaacagctctggcggcagccctgcaagagaagccagcttttcaggagagtacagctgggattgatgcagcctttgtacaagacttaaattgtcacgcactgtcccgtcgagcacgggagccgattgaaacgcgagggctgccgttctcctcagctcattgacattccattctctgacttcctttccatatatgttgacttcgccgctgtcaggcgttctcattaaattacacatagaaaggagggtgcttttgcctgagccggaagggcctaaaacggctacgattgcaccctgttgaatgtctccggtgacatcctgcagcacatcataggtttgtccatcttgtttatagctttttctgactgatctgaaggagatggctggtatgttttgtgtttgatcgtttgcttccattacaataatcacctttcaatataagtaggctgacattatatttaactataacgtgaaacagattccttttggtagcacaaataaaggagaacaggctttcacccattctcctgcagatgctacgcagtcagatttgactgtgctttctttttcggttttctcggctgtgaagcgaaggtatgtaacatcatccccgctattataatgaacaaaccggcaaatgataatagagatgggaaaacgcctgacagcagaacaatttcaccaagcagcgcgaaaatcacttcaccggattgagtggcttcaacagctgcgagtttttgcggattgtctcttaccatatcagtagcccagaaaaataaaaccgtcgcaatgatgcctgagctgacggcaacgataaaggattgaacggtttgacttgctgttggaaggccatctgaccaccagccgtaagctgctaatataagccagaatggaaggcttgccaatgtcattccaagcacgcgctgaaatgtatcaagccggcctccgtattcttcgagcattctcctgtttcctaacggataggcaaaagccgcaatgacaaccggcagcacactgaaaagcagcatcctcccagaaagcgattctgcatgctgaagctgaatcagagccgctccaatcaggatgatcacggaagtgccaagtgaaaccaggggaatcttttggcgaacgagctgcggaccgcccggcatatcttgtttgacataaaacaaaggagataagagcaccccggctacaattgtaatttgccaggttccggctatgagccaccccggaccgtatgcagccgcaaatgtaatcggcgcgtaaaaaagcacgaaaccgacgaagctccatttgatccaataaaacggctttttcctcatctctagtaagagaggcgtgaatgtccctctcatgatgacaatcaaacataaaaatggcaccataaaaataaagcgcagcgaagagctccaaagccagctgcctcctgataactccatcgctctgtttaatataaaggtaacggcgaaaaagagtgaagccaatattccgataacgatagctttcatgatatccctcattctggcattatttttttatactatactattcggtatcatgcagatcaatggaatcatgagaaaaacatcatgtttggcgaactgctatgtgtggaagacaaaaaagggaggtgaaattgatggaaaaagagacacagacatacttctttccggatgacggcaggattccgaatcaccctgattttccgctcgtggtgtatcaaaacgcgcttaaggacactggactggcagagcggatcgtcatccggcatggctggtcaaacagctggtcagggagtgtttttccataccatcattatcacagcaatacgcatgaagtcctgattgcccttaggggagaggctgtgattcagtttgggggagaaaaaggggctgccatccctttcaaatcaggcgacgcagtcgtgattccagccggagtcggacataaaaagctcagctcaagccccgattttactgtccttggcgcctatcccggtggcattcagtatgatatgaagacgggaaagcccaatgagcgagaggaagcggtcaaacagattaagcaggcggcgttgccggcgaatgatccgatcacaggaaaaagagagcctctattggaaatatgggtaaagtgaaggggagaaattgctggattgtcaataactagtgccgcagaaacgatatgacatgtgctccatataaattaatttcataatcgaagcaattcacgttcaaattttgttcaaaaagtgttatcatatagaaggtaatcgaattggagttttttgtgtttgctattttcagagagagtaaaggattttgacttattcaattgtttatttttagataaaaataatactgaatatggcaagatgaaaaactgggtagtaaacatttatttttgtaaatgattgtgcacgaattcacaatccttattcttatgccttaaaagcgtgagacagggagaggcactaccctttccaaaaaaatcagcaaactgcttatagtaaaggagaattggatatgccagaaacaatcgatcaaacaaatgcgtctgtcagccaaagccagcaagatcttattgatcagctattaaagccagaagttcaagaatcattgactgttttagttgaccagcttccgaagctgactgagttagtcaatattttaacgaagtcttatgatttcgctcagtctgtagcgactgacgaagtgttaaaaaacgacacagtcggtgcgatcactgaaattcttgagcctgtaaaagaaacagcgaaagaagtagctgcgactgcgatcgaagcaaaagaccgcgcggaagcaagcaacgaaacaattggtcttttcggcctgctgcgtatgctgaaagatcctcaagctcaaaagttgttccgttttgctaacagctaccttgaagtcatgaacgaacgcgaaaaccaaaaataatctcagattcaaattgatataaaggacggaggatatacgatgtcaaaacatattgtcattctaggcgctggttatggcggagttctttctgctctaacagttcgcaaacattacacaaaagaacaagcacgcgtgacagtggtaaacaaatacccaactcaccaaatcattacggaattacaccgccttgctgcaggcaacgtgtctgaaaaagcggttgcaatgccattagaaaaacttttcaaaggcaaagacattgatcttaaaattgcggaagtaagctctttctctgttgataaaaaagaagttgcgcttgctgacggttctacattaacttacgatgcgcttgttgtaggtcttggttctgtaacggcttacttcggcatcccaggtcttgaagaaaacagcatggtattgaaatctgctgccgatgcgaacaaagtctttcaacatgttgaagatcgtgtgcgcgagtactctaaaacgaaaaacgaagcagatgcaacaatccttatcggcggcggcggcttaacaggtgttgagcttgttggtgagcttgctgacatcatgccgaaccttgcgaaaaaatacggcgtagaccataaagaaatcaaattaaaacttgttgaagcaggtccgaagatccttcctgttcttccggatgatcttatcgagcgtgcgactgcaagccttgaaaaacgcggcgttgagttcttaacaggtcttcctgttacaaatgtagaaggaaacgtaatcgatctgaaagacggatctaaagttgttgccaacacatttgtttggactggcggcgtacagggtaacccattagtcggtgaatcaggtctagaagtgaaccgcggacgcgcgactgtaaatgacttcctgcaatctacatctcatgaagatgtattcgttgctggagacagcgcagtttacttcggtccagacggccgtccatacccgccaactgcacaaatcgcatggcaaatgggtgagctgatcggttacaacctattcgcttacctggaaggcaaaacgcttgaaacattcaagccagtaaactctggtacacttgcaagccttggacgcaaagacgcggttgccatcattggtgctaattctacaccgcttaaaggtcttcctgcttccttgatgaaagaagcaagtaacgtacgttacttaacacacattaaaggacttttcagcctggcttactaatccttttaatgaatctgacattgccaaaagcgttccttaccgagtgctttctggcaatgtctttttttatgtttatgacagcgttaacatttcattttcaaaaaagagattgatcccagaggaatataaaggtaaaataaaaacaaatcaaaatgttaacgttaacattttgaaatagaatgaaagacggtgaggacatggaacccttcatgggcgaaacctttttattgaaaaatgaaaccgctgtcagcctctatcacaattatgcgaaagacatgccaattattgattaccactgccacttaagtccgaaagaaatctatgaaaataagacatttcaaaacatcacggaagcctggctgtatggtgaccattataaatggcgcatcatgagagccaatggaattgaggagacatacattaccggagatgcgcctgatgaggagaaatttatggcttgggcgaaaaccgtgccgatggcgattggcaacccgctctacaactggactcacttagaattgcagcgtttttttggcatttacgagattttaaacgagaagtccgggccggctatatggaaacggacaaatgaactgctcaaaggggaaggcttcggggcaagggatttaatcgtgaaatcaaatgtaaaggttgtgtgcaccacagatgaccctgttgattctcttgaataccatctattattaagagaagacaaagactttcctgtcagcgtgctgcctggatttcggccggataaagggcttgagatcaatcgtgaaggctttcctgagtgggtgcaggcgcttgaagatgccgccgccatatccattgcaacctatgatgagtttttaaaggcgttggaaaaacgagtgcgattcttccactcagccggcggcagagtttctgatcacgcgatagattcaatggtatttgccgaaacaacaaaagaagaagctggacggattttttctgacagattacaaggaacagaggtttcttatgaagatgagaagaaatttaagacatatacgcttcagtttctttgcggtttgtatgcggagctcgattgggcgatgcagtttcatatcaacgctttaagaaacacgaatacaaaaatgatgaaaaggcttggacctgatacaggctatgattcaatgaacgatgaagaaattgccaagcctttatacaagctgctgaactcagttgagatgaagaaccagctgccgaaaacgattttatattcactgaatccaaatgataactatgtcatcgccagcatgatcaacagttttcaggacggtattaccccgggaaaaatacaattcggcacagcctggtggtttaacgatactaaagacgggatgctcgatcaaatgaaagcgttatcaaatgttggccttttcagccgttttatcggcatgctcaccgattccagaagctttctttcgtatacgcgccacgaatatttcaggcggatcgtctgcaatttgattggggaatgggtggaaaacggcgaagtgccgcgcgatatggagcttctgggaagcatcgttcaggggatttgctatgacaatgcgaaacactactttcaatttcaagaagagaaagcaaacgtgtaacaaagtgtccgctcagtatcgctgagcggatcactatccgaaaattcttaagacacagaggtggaacatgcgaactgaactggcaaataaggttgtgtcggtcgaaacggaaaaaaggctttcattgaaagagaaaatgtcctatggttttggtgattttggcaatggttttatgtttgatctcggccagatttatttattgaagtatttcactgatgtagcgggaatccccgctgcgatggccggcggcatttttttagtcagtaagctgtttgcggcgataacagatccaattgtcggctcatcaatcgattatcgcaaaaacatcggcaaacgggggaaattcaggccttatctattaatcggcagcctcgtgcttgcggtgcttactgttcttatttttctgtctcccaatgtatcaacgactggaaaactgatttatgcatatgcatcctatatgatttggggcatcggctattcgtttgtgaatattccgtacggctcattaggggcagcgatgactcaaaattctgaggaacggacctccatttcgacgttccgccaaatcggatcacttggcgccttgtttatcacaagtgttgccgtgatgccgctgctcatcaagtttgataatccgaaggtcggctacccggtggtcatgggcttgttcgccgcactcggtgtgctttggttttatatttgctaccgcaactgcaaagagcgcattgtcatatcggaagcacccaaagaaaaattaacactctcatctgtcgtcaaaacatttattacaaataaaccgctgttaacccttgtcctgatgacgattttttcaatttccgcatacaacattaaatccgccatgctcgtctatttcgcacaatataacctgggcaatgttgaattaatggcttatatgaactttataattatcggttcttcctttttgggcgtcgtattccttccaaagctcgtcaagatgtttggaaagaaacgaacggcaatgatcggcttcggcatcagtgtggccgcggatctgatcaactttatgcttccatctaacgtttatgtgtttacaattctcgccagtatcgcctttattggaatcagtatcccaaatggcatcacgtgggctcttgtctccgatattatcgactatggcgaatggaaatccggtgaacggaaggaagcaacgacatattcacttttcaatttctccagaaagcttgctcaatctttgtctggctttctctcggggatcggtttggggattatcggctatgttccgaatgcagtccagacagcacaggcgctgattggcatcaaagcgctgcttcttctgtatccggccattgctttggcattagcgatgatcattatcagctttctttataaactcacagaccagcagcatgctcagatcgttcaggatcttcatcaaaagaactgacaatataatataaagaatatttaaaataatttgtaaataaaatgtgtttgtaggggtttcgctaggggagtgcccaaaaaactgaaaaggaaggaggcacttgtttgaaaacgataacaattgcagctaaagaagcaaaggaactcgttcggcaaaagctggccagtgccggtttgaatgaacgagatgctgaaaaagtagcagatgttctcgtgcacgctgatttgcgcaatgtacattcgcatggcgtgctgcgcacagaacactatgtaaacaggcttttagcgggagggatcaatcctggggcacagcctgtttttaaagaaacggggcctgtgaccggggtgcttgacggagacgatggtttcggtcatgtgaattgcgacatggcgatggaccatgcaattgacatggcgaagaaaaaaggagtcggcatggtcacggccgtaaacagcagccattgcggagcgctaagctattttgtgcaaaaagcggctgacgaaaagctgatcggaatagcaatgacgcatacagacagtatcgttgtcccgtttggggggaggactccttttttagggacaaatccgattgcttacggtgttccggctaagcataaaaaaccgtttatcctagatatggcgacatccaaagtggcttttgggaagattctgcaggcccgtgaagagggcaaagaaattcctgaaggatggggagtcgatgaaaacggagaagcagtaactgatcctgacaaggtcgtctcactttcaacattcgggggcccgaaaggctatggactatcgattgtggtggatgtattttcaggattgctggcgggcgcggcttttggccctcatattgccaaaatgtacagcggtcttgatcaaaaaagaaagctggggcattacgtttgcgcgatcaatccagccttttttactgactgggatacgtttttagagcagatggatgccatgattgatgaactgcagcaatcaccgccggctgttggattcgaaagagtgtatgtgcccggcgagatcgagcagctgcatgaagaaagaaataagaaaaacggaatttctatcgcccggagcgtgtatgaattcttaaaaagcaggtgagaaaaatgaaagcggttcaagtgcgaaaagcgtatgatctggtgacagtggaggtgaagaagccagttctttcaaaggatgatgaagtgctcgtgaaagtcaagcgagtcggcatttgcggttcagacatgcacatttatcatggaacgaatccgctcgctaccctcccgagagtcatcggacacgaggtaacgggacaagtgaaggaagttggtgcgaaagtacagagcctaaaacccggtgatcatgtggtaattgagccgatttcttattgcggatcgtgctatgcctgccgcaaagggcggccgaatgtttgcgccaagctttctgtatttggcgtacatgaggacggaggcatgcgggaatatattgtgcttccggaaaggcagcttcacgcggtctcaaaggacttgccttgggaggaagcagtcatggccgagccttatacgataggcgcccaggcagtgtggagaggccaggtggaaaaaggtgataccgtcctgatccagggagcggggcccatcgggatctgtgtgttgaaaatggcaaagctggcgggtgctgttgtcatgatgactgacttgaacgatgagcggctggcatttgcgaaagaaaacggcgccgatgctgttgtaaatgtccaagcagaacatgttgccaagcgggtccttgaatggactgggaatgaaggagcaaacgtggtcattgatgctgtttgcctgccggagacttttgcgctttcaattgaggctgtgtcaccggcgggacatgtggttgtgcttggatttgatgaaagagcggctcagatttctcagctgccaattacaaaaaaagaagtcacgataaccggatcgcgattgcagaccaatcagtttccaaaagtggtagagcttttgaatggaggccggttagtgcataacgggctggtgacccatacattttcagttgatgacgttcatcatgcatttcagtttattaaggagcatccagatcaggtgcgaaaagccgtcatcacgtttgattaaatgactgaatccggaggtgcgagcatgaatatgacattccgatggtatggaagaggcaacgatacagtcacacttgaacacgtgaagcaaattcccggtgtcaaaggcatcgtttgggctctccatcaaaagcctgtcggcgacgtgtgggaaaaagaagaaatcagagccgagaccgaatatattcaatcctatggttttcatgctgaagttgtagaaagcgtgaatgttcacgaagcaattaaacttgggaacgaagaacgcggccggtatattgaaaactacaagcaaacgatccgcaaccttgccggatttggcgtgaaagtgatttgctataattttatgccggtttttgactggacacgcacggacatgttccggccgctagaagatggatcgaccgctctgttttttgaaaaggccaaggtggaaagccttgatcctcaagagctgattcggacggtggaggatgcatctgacatgacactgccggggtgggagcccgaaaaattagctcggatcaaagagctttttgctgcctacagaacggtcgatgaagaaaagctatgggacaatttatcattctttttgcaggaaattcttcctgttgctgaggcctatggtgttcaaatggccattcatccggatgacccgccgtggccgattttcggactgccgcgcattatcacaggagaggcaagctataagaaactgcgggcgatatcagattcaccgtctaattgtatcaccctttgtacaggttcaatgggagccaatcccgctaacgacatggtggagatcgctaaaacgtatgccggcatcgctccattttcacatattcgcaatgtgaaaatttatgagaatggcgattttattgaaacatctcatttaacaaaggatggttcgatcaacattcaaggcgtgatggaagaactgcataagcaggattacgaaggatatgtcagaccggatcatgggcgccatctttggggcgagcaatgccgcccgggatatggcttatacgatcgggcacttggcatcatgtatttgaacgggctgtgggacgcttatgaagcaatggcaaaaaaagaggtgggcatatgatcccgctgcatgagaacctggctggtaaaacggctgtcatcactggcggcagcggcgtgctttgctctgcgatggcccgggagctagcccgtcatggcatgaaggtggcgattttgaatcggacggctgaaaaaggccaagcggtcgtgaaggagataacggcggctggcggcacagcgtgcgctgttgctgcggatgtgctggacaggatgtcactggagcgggcaaaggaagacatccttggccaatttggcgctgttgatctgttaattaacggggctggcggcaatcatcctgacgcgataaccgatgtggagacatatgaagaagcgggagaaggccaatccttttttgatatggatgagaggggctttctaactgtattctccaccaacttcaccggtgcgtttctggcctcgcaagtgtttggtaaagaactgctgaaggcggattcacccgcgatcatcaacctttcttccatgagtgcttattcacctatgacgaaggttccggcatacagtgctgcgaaagcatccatcaataattttacgatgtggatggctgttcattttgccgaaaccgggctgcgggtcaatgcgattgccccaggcttctttctgacaaaacaaaatcatgatctgctgatcaaccaagacggaacgttcaccagccgatctcacaaaattattgcgggaacaccgatgaagcgcttcggaaaacccgaggatttgctcggtacgcttctttggctggcggatgaatcctattccggttttgtcactgggatcaccgttcctgtcgatggaggatttatggcttattcaggtgtgtaacgaaagcggtgcaacagaaactgaaccaacataggggtgaggttgagatgttttcaaaagataagcttcccgttatcctttttttgttcctggcaggggtgattaattacctggatcgctcggcgctttccattgcagctccttttattcaggatgatctcacattgtctgccacgcaaatgggcttgattttcagcagtttttcgattggttatgcgatttttaactttcttggtggcgtggcatccgaccgctatggggcaaagctgaccttgtttgtcgcgatggttgtttggtcgctgtttagcggagcagtcgccctcgcttttggttttgtcagtctgctgattatacgcattctcttcggaatgggagaaggcccgctttcggcgaccatcaacaagatggtgaacaactggttcccgccgacccagcgggcgtctgttatcggtgtaaccaacagcggcacgccgctcgggggagccatttccggcccgatagtcggcatgatcgcagtggcgttcagctggaaggtatccttcgttctcattatgattattggattgatatgggcagtgctctggttcaagtttgtcaaagaaaagccgcaagagacgattaaggaagcaccggcaataaaagcagaaacgtctcccggagaaaaaattccgctcaccttttacctgaagcaaaaaacggtcctgttcacggcgttcgcttttttcgcttacaactacatcctcttcttctttttgacgtggtttccgagctatcttgtcgacgagcggggattaagtgttgaatcgatgagtgtcattacggtcatcccgtggattttaggctttatcgggctggctgcggggggatttgtttctgactatgtgtacaaaaaaacggcccgaaaaggtgtgctgttctcgcgcaaggttgtgcttgtcacgtgtttgttttcatcagctgtcctgattggatttgccgggcttgtggcaacgactgcgggggctgtcactcttgtcgctctgtcagtgttctttctttatttgaccggtgctatctattgggctgtcattcaagatgtggttgatcaaaacaatgtcggttctgttggcggcttcatgcatttcctcgccaacacggcaggaattatcggcccggctttaaccggatttattgttgaccaaacaggcacgttttctggagcatttttgcttgccggagggctggctgtcttcgcttcacttgctgtgattcgttttgtccgtccaatcatcggcaagccagcgggaacagaagctaagaatcctgtgtcttattaatctggaaatatagtgggagaggcggtatatttgatgatacaatatacagtaaataatcgcagccggtatgataaggaagggaattagatggtaaccataaaagatatcgcaaaactcgcaaacgtatcccacacaaccgtttccagagcactcaacaacagcccttacatcaaagaacatacgaagaaaaaaatattagagctagcagagcagctcaactatacaccaaatgtaaatgcgaaaagtttggcgatgcaaaagtcgcatacgatcgggcttttctttacaagcattacaaacggaacctcacacagcttctttgcagacacaatcaaaggcgtcaatcaagccataagtgaggattacaatctgtatgtgcgcggcattgatgatctgaaaaactatgactccgttacaccgatgagatatgacggcatcattttaatgagccaaagtgacattgataattcttttatttaccatattcgcgaaaaaaacattccgcttgtcgtgctgaatcgtgatattgatgatcgcaccatcacgaatattttgtctaatgacaaggaaggctctcaagaagctgtagaatacttcattcagtccggacatcaagacatcgccatcatcgaggggatcgaaggctttaaatcctcccagcagcgaaaggaaggctacttatctgcactgattcaacatcatattccgatcaagcatgaatacagtgtcaaaggacagtacgatatggaaagcggctttcaagcgatggagcggctgctggcactgccgaatcctccaaccgctgttttttgttcgaatgatgacatggcaatcggagcgatgaatgcgatattcgcaaagggcctgcgcgtccctgatgatatttcggtgatcgggtttgatgatattggtttttcacagtacatcacgccaaggctttcaacagtaaagcgcccagtggagaaaatcagcgtgcttggcgcgcaaaaactcttgtctctgatcagcaagcccgaaacaaaagcagaaaaaatcttggaaaacacagaatttatggtgcgtgattcagtcaggcgattgacgacgtgatgtcccgtttttcagcgggcattctttatacagaaaaatgttaacgtgtgcataaaaggagagggaggcaatacgggtgcagaagctgaataaaaatgtgtacgatcactatactcagtatccagaaaaaattctccagttcggagaaggaaactttcttcggggatttgtcgattggcagattgatcaattgaatcaacacactgattttaatgggagcgtggcagttgtccagccaagaggctcagaaaaaatcaaacgattaaatcagcaagatggattatatacgctttttttacaaggaatgaaagacggagaagcggtaaacgagcatatgattatcaactcaatcagccgggggattgacctgttttctgattatgaagcatacaaagaattggcatcaagcgaaaggcttcggtttattatctccaacaccactgaggctgggattgtatgtgatgaaaaagatcgtttagaggataggccgcaaaaaacattccctgggaaattaactgcatttctctacttccgctatcaggcttttaaaggagatcagacaaaagggtgtgtcctaatcccatgtgaactgattgagaacaacggcgaaaagctgaaggaaacggttcttcattatgcaggtctgtggaagctggaggaaggatttacacagtggattcatgaggccaatacattttgtaatagtttagtagaccggattgttccgggttttcccgtcgacagcattgatgagatcacggcggatcttggctatcaggatgatttgatagttgtgggagagcaatattatttatgggttatcgaggggcctgattggattggaaaagaacttccctttgcggctgcagggctccatacaaagatcgtcagcgacctcaccccataccggactaaaaaagtaagaattttaaatggcgctcatacagcaatgacgccagtggctttattatacggcttgaagactgttagggatgcagtcgagcatccggaagttgggcgatttataagagagctgattgatgacgaaattcttcctgttttaaaaatggaaggtctttctcagtatgctgacgatgtgctgaaccgttttaaaaacccgtatattaagcattacctggaaagcattgcattgaacgccatttccaaattcaaaacgagaaacctgccgacacttaaggaatatgctgaacaaaagggacagcttcctgaacgcttggtgttttctttcagtgctcttctgtatttttatcataataatgagacattgcaggatgatccggcagttcttcaatttttcaaagaggtttggtgtcaggaggatggcgacatgcttcggattgcatcaagagtgttaggcgaacagtggctgtggggggcagatctcaatgagataccgaagctgactgatagagtcgctgtttacttgaatcatattcatgagctgggcatgcagcgggctcttgaacaatactgcatacaagggggagaggtacgttgaagtcgtttataaagattcataagcaagataatgtccttcttgctctgcgggatatccaaaagggagagaggctgcatgcggacagcgtgtcgattgaagtaaaggatgatataaaaagaggccacaagattgcattgaagcctattaaaaaaaatgacagcatcatcaagtacgggtttccaatcggtcatgcatcacaagatatatcgatcggagagcatattcatgtccataatacgaaaacaaacctgtctgatatccaatcatacagctatacaccgagatttgatgaaaatccgtattctaatgagaaccggacgtttaaaggttttagaagagaaaacggagatgcgggtgtacggaatgaattgtggattgtcccaactgtcggctgtgtcaatggaatagcagaaaaaatgctgcagcgttttgtcagagaaacaggggatattgctccatttgataacgtactggtgttaaagcatcaatacggatgctcgcagcttggcgacgatcatgaaaatacgaagcagattctgctgaatgccattcgccatccaaatgccggcggcgtcttggtgttagggcttggctgtgaaaacaatgagctggcaagaatgaaggaagcactgcaagatgtgaacttgaagcgggtgaagtttctggaatcccagtcggtgaccgacgaaatggaggcaggcgttgctttgctgaaggaaattcatgaagcggccaaagaagataagagagaagacattccactgtctgaactgaagatcgggctgaaatgcggaggttcggacggtttttccggcataaccgcaaacccgctgcttggacgtttttcagattatctcattgcacagggagggagcacggtgctgacggaagttccggaaatgttcggcgcagaaaccatcctgatgcagcgggctgccaatgaagaagtgtttcataagatagtccaattaatcaatgattttaaacaatattttatcaaacatgatcagccggtgtacgaaaatccttcaccgggcaacaaagcgggcggcatttctacacttgaggataaatcgctgggctgtacgcaaaaagcggggatttctcttgtcacggatgtcttgaaatacggggaagtgctcaagacaagagggctgacgcttttgagcgcgccgggcaatgatttgatcgcctcctccgcattggcggctgccggctgccaaattgtcctctttacaacgggaagaggcacgccgtttggcacctttgtcccgacggtgaaagtagcgacaaacaccgagctgtatgaggcgaagccgcattggattgattttaacgcaggtcttttagcagaggatgatgttcatgaggaatatgtgctgcgtgagtttatccactatatgattgaggtggcaagcggccagcttgtgaaccatgaaaaaaatgatttcagagaacttgccatttttaaatcgggtgtgacgctataataagaaaaggctatccttcaagcggatagccttcttcattaaatcaattttaaaccgctgactaaaataatggacgccataataaattgcagcggacgcggggagaatcgaggcgaaagatggctcccgatcagcacgccgggaattgaaccgaggagcagattagctgccagcatgtaatccacgcttccgaagcttgcgttcaaaatgcctgctgccgtaacaagaagaaaagcatgcgcgatatcggttccgacaatctgtgacgctttcatgttaaataagtaaatcatggcaattgcaaataatgagccagaaccgattgatgttaatccgacgataaacccaaacacaacaccaataagaattgtcagcgccctcttattttcaagcggcatcagctgccagcggttggggcgaagttttctatccaaaaacaaacgaacgatgattgaaatggcaaccagcgttaacacatatcctagagcgtgcttaataatttcttcctgatgctggtgaaaggcggggaacaaatgcaatatgccaatggctagcgaagcactcggaatactgccgatggctaagtattttaccaatttaaagttaatcgttttctgccgccaatgggaggcaacgccaaacagctttgtgatcgagttatatacaagatccgtaccgaccgcgatggaaggattaattccaagcacaattaaaaggggagttaataaggccgctccacccactcccgtcaatccgactaaggctccgacaaacaaacccatcaatatgatgcttacactcatgataaaggcctcctgaaaacccgactatttttatcagattatatatgattaggacgcgttaatcaattaaattttttgaatttttgcacgttagctgcttgaaattttggtatgctcaatatctctattcatttgccctataatgagtgtctggacgaaatcgagaagtactaaaggcgcaaaaaaaagatacctcttaacaggtatcttttttcttgtttacgctacatgcgctgctgatagaaaggaagctcagtgtggcccatttcccgcacatacacgaacaggttgcctttatggtgaatttcatgctccattgcaagctgaagcagcgcgcggcctgtgacttttctgccgaaagcggatgtcagatcaatttctctgtccagctgctcttcagtcagctgttcaaggatagcggccgttttttctgtatatgtttttgccagaacattgagatctgtttctgtttcctcctgcttgttttgaaatggtgaggcattgccttccttaatgacatttgcgaacaagtggaaagacgtaagaatgtgtttgaccagttcttctgctgacattgatgtttctgccggtttgtagctgtaatggtctttgctgattttttcggcaagctcattggtcacgtttcgatgggataaaaaatggctgacaatttgattggattggctcattatgatctcctccatatgtaaaaataaatggtgcaatgaaatcctatatcaacggttatgaattcacaagtaatatgctgtgggatgaaacaaaatgctatgtcaatcgtatatataacgttcacaaaacatgaaatggagtataaacatgactaacatacctttcatttatcagtacgaagaaaaagagaatgaaagagctgcggcgggctacggcactttcggttaccttatcacacggattgaagaaacgctttatgatcaatacggtgtattctatgagctctatgccagtgatgatccaaatacggaatactgggagcttcttgtagaagatgtccgcagcggttcattggagcctgagcatgtggcatatatatttgaaaagcttgaaaagaaaacctttgcttacgatgaagatgagaaagaaccggattataccgtccataagtctataagaaacagtgtatacgcgtatcctgaaaagggagttgcttttgccagaattccatattttcaagatgggagcattatgagttttgattgtctgtttgcggttaacgatgaaaagatgcgtgcatttctggagggagtcagaccgcgtctttgggaaaaaagcaagcggaaagtgaccgtgtttacggatggagatggagggacttcaagagagcaggaagccattgtcagagaggttcagcggagtcaagtcatcatgaatccgctattgaaaaaagagatatacagatcaattgatcagttttttcatagtgataaatcgttttatcaaacatatgacatcccttacaagcgcggcattctgttatatggacctcctggaaacggaaagacgacgttagtgaagtcgatcgcaggcagtatcgatgcacctgttgcttattggcaaattactgaatttacgtcgagcgagacaatagaagaagtctttcaggcagcgagacgcctcgctcctgcagttctggtcatcgaggatatagattcgatgccggaagatgtgcggtccttttttctcaatacgctggacggcgcgacatcaaaagaggggctatttctcatcggtacgacaaactatcccgaagagatcgatccaggtttgatgaatcgtgcagggcgatttgatcgtgcctatgaaatcgggcttccggatgaagagctgcggctggaatatatgaaaatgagaggctttggcatctttttgagtgaaggagaaataaaaaacgccgcaaaacttacagaaggcttttcctttgcacagctgggagaattatatgtatcttcagcccttcaatggcaccaagaagggaatcaccatattgaaaccatggtgaaagacatgacaggagagcaaagaaaaagccagcggggaagctggatggaaagaaacaaagtcggttttcactaaaagaaagcacgggtgtttgaaaaacccgtgcttttttgttgcggttagccgaaattcgacaattgcggttattttgcgttcttctttttcttgcaaatatgataaaatatgacatatctcgggtaattcaaaaaggggggattaattgaggatgaagcagacgattccgtcctcttatgtcgggcttaaaattaatgaatggtatactcatatccggcagttccacgtcgctgaagccgaacgggtcaagctcgaagtagaaagagaaattgaggatatggaagaagaccaagatttgctgctgtattattctttaatggagttcaggcaccgtgtcatgctggattacattaagccttttgaagaggacacgtcgcagctagagttttcagaattgttagaagacatcgaagggaatcagtacaagctgacagggcttctcgaatattactttaacttttttcgaggaatgtatgaatttaagcagaagatgtttgtcagtgccatgatgtattataaacgggcagaaaagaatcttgccctcgtctcggatgatattgagaaagcagagtttgcttttaaaatggctgagattttttacaatttaaaacaaacctatgtttcgatgagctacgccgttcaggcattagaaacataccaaatgtatgaaacgtacaccgtccgcagaatccaatgtgaattcgttattgcaggtaattatgatgatatgcagtatccagaaagagcattgccccacttagaactggctttagatcttgcaaagaaagaaggcaatccccgcttgatcagttctgccctatataatctcggaaactgctatgagaaaatgggtgaactgcaaaaggcagccgaatactttgagaaatctgtttctatttgcaagtcggaaaagttcgataatcttccgcattctatctactctttaacacaagttctgtataaacaaaaaaatgacgccgaagcgcaaaaaaagtatcgtgaaggattggaaatcgcccgtcaatacagtgatgaattatttgtggagctttttcaatttttacatgcgttatacggaaaaaacattgacacagaatcggtctcacacacctttcaatttcttgaagaacatatgctgtatccttatattgaagagctggcgcatgatgctgcccaattctatatagaaaacggacagcccgaaaaagcactttcattttatgagaaaatggtgcacgcacaaaaacaaatccagagaggagattgtttatatgaaatctaaatggatgtcaggtttgttgctcgttgcgatcgggttcagctttactcaggtgatggttcatgcaggtgaaacagcaaacacagaagggaaaacatttcatattgcggcacgcaatcaaacatgatgcataaaaaaagacccttaggggtcttttttatttcttcagcttccattcttttatcgtcagctcagaagatccacttgccaccagcggatccgcatggccgatttccgctgcctcttccagtgaatctgcttcgatgacatacgctccgcctgtggcgtcgctgaatggcccaaacatttttaaacgtttttctgcctgtaaacgatccagaaattcatagtgcccagccacatgctcctgattaaatttctccgttctcattgtcagcattaaatatgtatacatattcagaccctccgtgaacttcagtttaacacatttatccatattacagtgatagatgatatgagcttttcgtcctacgaatgccacctatttatgaaaaaagaaaaggagagatgataggtgagcattccagtaaagaaaaatttggtttctgaggcgaaatacgcgttgaagtgtcctaatgcaatgtccgctgaatacattaccattcacaacacggcaaacgatgcgtcagcggccaatgaaatcagctatatgatcgggaacacaagctcgacaagctttcattttgcagtcgatgatcaagaggtgattcaaggtctgccgcttaaccgaaacgcctggcacacaggtgacggcacaaacggtccgggaaaccgcaaatcaattggcgttgagatttgctacagcaaatcgggaggcccgaagtatgaggcagctgaagccttggcgatttcatttgtagcacagcttttgaaggagcgcggctggggcatcgatcgggtgagaaagcaccaggactggaacggaaagtattgcccgcaccgcattttatcagaggggcgctgggatcaagtgaaggcggcaattgaaaaggaattaaacgggggcgtatcagctaaaaaagctgcagtctcttcttcagcgtctgaatatcatgtgaaaaaaggcgacacattgtcagggattgccgcatcacacggagtcagtgtgaaaacgctgcaaagcatcaatcatattactgacccgaattacattaaagtcggacaagtgatcaaactgcctcagacggcatctgcttctaaaagccatgccgcatcctcatatccgctcccatcaggcgtgatcaaagtgacaagcccgctgacgaaagggacaaaagtaaagcaggtgcagaccgctttagccgctctttatttttatcctgataaaggagcgaaaaatcacggcgttgacggcgtttatggcccgaaaacagcaaatgcagtgaaacgttttcagtctgtcagcggtttaacggctgatgggatttacggtccgaaaacgaaagcgaaaatggaggaaaagctgtaaataaaaagacggaagctgtgaagcttccgtctttttatcttacatacaaactgcggcaagcaccttttgaatatcataaatgctctcatcttttttaaactgctttgagacggcaggaagttctgcgccggaaatccaaattttcagttctgaatcgaggtcaaagcggccggccgtttccacgctgaatctggaaatgcttttgtacggaatcgattgaaattccgttttcttgcctgtgattccctgtttatctacaaggataagccgcttgtcagtaaagacaatcaaatcgcgaaccagcttaaacgcggcttcaacattctcaccctccagcaaaatatgggcaagctcttctttcacagcagccgttgacagtgttgacgcattgccgagtaatccatcaataaaccccatcatatacctcctcttcgtattctatcaaatcatactataaaaaaggttttcattcatggatgagtagagtaaacttgtgctgactggtaaagggggcgttcaaaatggaagatatgtatgacagctttgcagccctttctgcttctgagtcggagtatcggattatttatgaggagaaaaacggaagtgagcttattgtcctcggtcctcacggcggcagaattgagcctggcgtcagtgaactggtgcgggcattttcggatcgatgttccatctatttgtttgagggtctaaagcagcgaaacaaccgttccttgcatctcactagcattcgttttgatgagccgctggctttagaaaaagtgaatgaccaccattacgcattagcgtttcacgggtattatgatccgaaaatcccgcatacattggtcggggggcggatcgtaaaaaagccaagctcatttgtgagcgtctgaatgaagcgggttttagcgccgagctcaccaatgagaaagaccgcctggcaggtgtacacccaaacaatattgtcaatcggacgaaaagagaaatgggactgcaattggaggtaagcacggcacagcgaaatgcgctattccgcaattttgggtgccgtgataaaagctacatacaaaacgatttgtttgatcgatatgtggaagccgtcaagcttggcttttataaataaaactagacgggacctgcacggtcggcctattccttcatacgctggggttgtgcgaaagtgtggggaggaatgattcatgttttatcatataaaagagcttcaatatcaagcaaagccagctcatcctgatccggtttatgcgaaaaaacttcaagaggtgctcggcggccaattcggtgaaattagcgtcatgatgcagtatttgtttcaagggtttaactgcagggcggatactaagtatagagatttgttatatgatgtggggaccgaagagattgggcacgtagaaatgctggcaacgatgatttccagacttctggacaatgcacccgcggatgtacaggaggatgcttataaaagcaatcccgctattgcagcagtcatgtcagggatgaatcctcagcacgcgattgtgtccggattgggggcgatggcatcagatagtgagggctatccgtggaatgcaaaatacattatctcaagcggaaacttgctggccgattttcgcgctaacttaaatgcggaggcccaaggacgccttcaggtgacacggctttatgccatgaccgatgatccaggggtaagagatatgctgtcatttttgattgcaagggatacctatcatcaaaatatgtggtatgcggccattaaagagctggaggaaagagaacgggatattgtcgtcccgacgacgtttccgcgtgagctcgaaaaacaggaagtctcctatgacctgtttaatttttccaggggggatgaaagctcacaaggaagatgggcacatggggaagcctttgacggccggggtgaattcaggtatatcccggctccgattgcgttcgcatctgcgcctcatcttaaaccggcgcccatgtggctgcataatacagttcccccaatgtcgaaatgttaggttctcttctgggctgaggaatatatcctcagcccttatttgatcagatgtttttgccaatatgatataacgctttttcctcagcgacctgcaagtgctgttgatcgccttcctcgtacgcatgtggccgcttgtgagataataaataagcgagccgcttctgaaattgaatacctgctttacgccgttcaaacatgtcaagccttttatcagcaaattcctttgttacccggaataccgccgaaattgtggcgagtgcctggcttctccattgcggcagttccatctgcaacagcataaaggttggcacacagaagtggtacataaattgatttgcctggaattcttgaagctctctgaagagcttgttcatctgaaaatgattgcctgcatgctttaacacgtggcacagctcatggccaaaatcctcccattgctcttcccgtgactttttttggtttaatacgatactatacatgccgtcgtatttcaccatcatgctccccatatcctcaaaatgcacccgaatatccagatcctttgcgattttcagcatgtcaatgtgatgaggggatgtgatgcccagccggccgtataaatttttaacgtattcctccagatgtgataagtaatcgcccaattgaatactccctttcgaacatttgttctatttttagcgagaaagaaaagcccgtataggactggaaagtagcgtagaaatctttcccttttctttaaaaaataaacacttttttctttatatcggtctactttttatatgttttagagaacagagaacgatttatttatttttcggtttgcggtttttctctttttcttttaaatagttgataaattcgatggcctgctgtttgctttctggggaaaaatcctgcatatcgcggtatgcaagctgcaggtccggatctgagaacatatcgtcatcggattttttgtctttccccgttaataagtaatcagtcgttacttgaaagtaatcagccagcttttggagtgtgtcgtaatcaggttcgcttcgcccattttcatagtgggaatatcgtgcccgtgacacaccgatgtgtgatgcgatctcttcctgtgtccttttccctctgagactcttcaatctgccgcctatcatactatgacctctcttttttaaactccctacgttacttatgattatagatacaaaatgtatcaaaataaagttatgataaaaaaagtatcaaaaataacttgatgatacagattgtatcgtttatacttggtaacatccgatacaaaatgtatcaaaaaagatcaggagagtgatcacatgtatccgatccaaatcgtttttagtgaaaatcccatagatcagcgccatctcggacaatccggcggcaccatttcgtttaccgcatgcggccttccggtgtttcactttgaaacgcaggaacagtttcaagcatacatgatgttaaaaggagaagcggcgtacaatgaaaaacgataaaagctatccttttccgacgtattcagggttattgaattcagaacattatgacaaaattggcccggcgttatggctgtttctctggtttatcagctcaacaacaaaagaaatcgaaaaagacggcgtaagctggggcatcgtactcggccataagccgttaaaagcgagagaaatggcggcagtcttcggcgtaagtgaaaaaaccgtcagaagatggctggagcttctcgaaaaccatgattacataaaggccgtccgtgcgccatacggactgatgatttcggtcaagcattccaaaaaattcagcttcagatcggacaatactgtacacgggagtctaaaagaacggccattttcgccgcagacaccggacacaaacgaccgtacagatatagataaaacaaacaaatatactgctgctgatgatgcagtggatcacattgcgaagcggtttacacaattacggtcggctcaagaaggacgcaccgtgtatccttcctcaagagattatcaagccatcgcccgcattgttgccattggcgttcctgtcacgcaaacaatcaaatggcttgaagaatgctttcaggcttttgaaaaccggcggaccgccgcttctgaaacaatcaaggcttttcgctactgctcgaaattcattgaagatcgatttttcgcgcagcaagccaaaaagaatgccgcaattcagcatgagaggatgaaaaaacatgacaaaacgaacaatcgaacagattttggacgagctgagaagagggagacgtccattactggcggacaaaccggccgaatcagacgcaagcaggtatgattgcctgcgctgcaaggatcagggaggttatctcgtcagacagaatggcctggaagtctggacgatgtgcagctgcatggcagaacgaaaagtgaagcggctgctgggtgcaagtgagattacccacgctttcagacagctcggcttcaaggaattccgcacggagggaaagccgcaggccataaaagacgcattggagtgtacaaaagagtatgttgccgattatgaacaaatcaaggattgccgaaaaaacagcattgcccttttaggacagcccggatcagggaaaacacaccttttgaccgccgcagccaacgaattaatgagaacatgctatgtgcctgtcatttattttccgttcgtggaaggctttactgatctgaaaaatgattttgccctattagaagcgaagctgaaccggatgaagcaggcggatgtgctgttcattgatgatctgtttaaaccggttaacggcaaaccccgcgctacagattggcaattagagcaaatgtattcggtactcaattatcgttacttaaatcataaaccgattttgctttcaagcgagctgacaattgaagcacttgtacgggtcgatgaagcgctcggcacgagaatctatgagatgtgcagtgactatttagtgattatcaaaggagcagcctacgagcttaaccatagattggagggcgtcagataatgtgcaagctttgtcaaacaaagaaagtcattgtggaacataccggtattggggtcgtttttcatccatgtccgaactgtcggtccggtactgacttaacgcctgtcattcaaaagctggagcaaatgctgacagcgggaaaagcgaggctgaatatctatgattaaacagctgactgcactaatcgctttgctgtttcgggcaaagcgaacagaaaaaaacattgaacaatggtataaggacgacgggaagtgaaagtgttggaaaaaacaaaacagacagagaaaagccctgcgccgtggcgtgctgtcccgtgcggggatacgaaaccgatctatatttattcagcttacagtgaagaagaaaaagaaagattcccatattcaaacggacggctgattgccgctgtatttgaccttagctcttattcgcaaaaaagcaatgccgctttgatggccgctgcgcctgaattgctggaagcgtctaaagcagcgcttgattttctgaaagggaattctgttcattcaaaggagcgcatcattcagctattagaaaaagctgaagcaagcgctgcaccgaaaaggggaggaaataaaacatgattcatcctaaaaaactgctgcatatcgattccgtcacgcttaagagccagctggaggacgggaaaatccgtgtcattattgtggatggcatcaagcaagaagcatggatcacagaagcgcccgagcatggaaaaacgctcgtcgaaacaagaaagggcgaccttgcccgagtggaatttgaaatcggctacaaattaaattaaagcgaaaacagaatacgtccaagacggaaagcctgcggacactgatcaactgcacagcatttgtgcgttgattggtgtccgttttttatttgccaaaaatgaggaggatcatagaatgcaagacttactatttgaatataaacgaacgctcaaacaaacaagaaaccaatataaaccgctcgctgaggcagatgaatccgtgctctcagctgaagagctgaaggataaaaaaatcatcagaaatatgattactgatcttgaatatgtaacagaatggcttgaaaaaggaaggcagcccggcatcagacgggcgattgaccggcgtgatgcttaccagcggctgatgatcaaggacccgagaatcatcgaatcattttccagcgctatgatgtttgagccggacggacaggtatcagaagaagacagagatagaattcgagaagcattagccctgttaacggacagagaaaaggaaatgtttttgctgcataaggtagaatgtttttcttatgaacggatcgccgatcttctcggcgtaaaaaaatcgacagtgcaaacgacgattaaacgggcgagtttaaagatgcaaagacagcaggaagacatgaatcgatcacttgcctgaaagcttgtcatacgtttgccacctataagtgaatagagcatgacacataagcggctggctgatcagccgcttttatgaataaacaaccatgctggaggtggcggtgatgccgtagcatgaaaacacaacttcgcgaacaagcattagcaatctatcaacaacatcaaggaaagatcacaaatcgggcgatcgcggacacaatcggtgtttccccgaaaacaatcggcatctggaaaaaacaagacaaatggaaagaggccctgttttctgcgtccaaaaacgaacaaaaacagcgccctatagacaacgatgaattaaatgaacgccagcggctgttttgcctgtattacgtcaaaagcttcaatgccacacagtcagcaatcaaagcgggctattctccggacagcgctcatgtgacgggcagccggctcttaaaaaacgaaaaggtcgctgctgaaatcagacgcataaaaaaagaaatggtcaatgaaatgtttattgaagcgatggacgtgctgcaggtttatatcaagatcgcgtttgcggatattacggactatgtgaccttcggaaaaaaagaggtccaggctgtcgggaaatcgggtccgctgtttgatgaagatgataatccgattatgaaggaaatcagctttgtcgatgtcaaagactccgggctcgttgatggcaccattgtaacggaagcaaagcttgggaaagaaggcattgccatcaagcttgcagataaaatgaaggcgcttgagaagctatccttatattttgatttgtttccagatcaatttaaacaaaaaattgaaaatgagaagttgaagcttgccaaacaaaaagcggagaaaacagatgacagccaagagccgattgaaattatgatcaaacgaaaagagggcaagtcatgattgtaaaagaaatcaaccctcatttcgaagattacgtgttcaattgggagcagacgtaccaatttctcgtcggcggctacggctcatccaaaagctatcataccgcattgaaaatcgtgctaaagctgctgaaggaaaaacggacggcccttgtgatccgggaggtgttcgatacccatcgggattcgaccttcgccttgtttcaagaggtgatcgaagagctcggtctcacaaaggctgtggcatctctttcttccccgctgcagctgcgatttcacaatggcagccggatcatgttcaaaggaatggacaatccggcaaaattaaaatcggttcataatatttcattaatatggattgaagagtgctcagaggtgaagtatgaggggttcaaggaattaatcggacgtcttcgccatcctgagctgaagcttcatatgatctgtaccaccaatcccgtcggcacctccaattggacgtacaggcatttttttcgggacgaacgcaataaacggtttgtgctggatgacagcgaactttacgaaaagcggacaattgtgaagggagatacgtattaccatcattccaccgctaacgacaatctttttctcccagaaagctatgtgaaacagcttgacgggctcaaagaatatgatcccgacctgtaccggattgcccgcaaaggaagattcggcgtcaacgggatcagggtgctgccgcagttcgaggtactcccgcatgatcaagtaaaaaaatgtatcgcagccatcagcaagccaatctttcgtacaggtatggattttggattcgaggaatcctataatgccgtcgtccggcttgctgtagatcctgaaaaaaaatacctctacatttattgggagtattatcaaaataaaatgacagatgataggacggctgaggagctgcgtgagtttattgagacacaggaattgatcaaagccgactcggctgagccgaaaagcatccaatatttccgccagcagggctttcggatggttggagccagaaagtttcccggctccaggcttcaatataccaaaaaggtaaaacggttcaaaaaaatcttctgttcggaccgctgtgaaaatgtcatctatgagctcaagacacttacgtatgccaaagataaaaacggagctctgattgaggatgaattcacgattgacccgcatacgctttctgccatttggtatgcgcttgatgattatgaggttgctgatatgaaagagacagcacacaaacgaatccggccgaaccgagaaaggaggaggtcataaatcatgcacaatcaaacagtcagagcaactgtatttaaagccaatgccgaggctcctcagacaaagcaaatctatgaggatgacttttctgagctgtacggagaggacattatcgctccgccctacaatatcatcgagctcaaaaccattgccgaatactcgaccattcttcagcaatgcattgatgcgtacagagtgaatattacaggctttggattcgatgttgagtacacatttgatgtcaacgcaagtgatgtcgatcaggcaaaaaagaaaagagcggaaaaagactgggccagactcgaagccttttataaatgtcttcactttgatgaatcagctgaaatgattttaggctatgccatcgaagacagagaaaaaacaggcaacggatttatggaagtgcttcgcgacggggcgggaaaacctgccggcatcgaatatttagatgtgaaatatatgcgtgtatgcggagcaggcgagcctgtagaggtttcatttgtatatgaagaaaacgggaaaatgaaaaggatcaaaaggcaaaaacgcttccgaaaatatgtgcagatgatcaatggaaagaaagtattttttaaagaatacggcgatccgcgaaaaatggatattcgcacaggtgaatatgtaaacacattggcagagaagtatcaagcaaatgaagccattcacctcaaaatcggaagcggcgtatacggtgtaccccgctggatcggcaatattgtcaatttatacggggcccgaaaagcagaagagctcaattttatgtattttaagcaggggcgtcacgtccccgctgcgattacagtggaaaacgggatgctgtctgaagcttcttaccgggagctgcaggaatacatgaatgatcttgaaggcgtggagaacgcccataaatttctcctgatcgaagcggaaggaatcgcaaaagaaaaggatctccacggaggcgaggatattacgccggtttccgtggaaatcaaatccttggcggaaattctccaaaacgacgccctgtttcttgaatacgatgaaaaaagcagaaataagctgcgttccgcgttccgcctcccgccgctgtatacaggcgaggcccaggaatacaaccgggcgacagctgatactgctagaaaaattacggaggagcaggtttttcagccggagcgaaaaacgctcgtgaataaactgaacacgctgcttttgccggagctgaatatccatgacgtcaggctgacattaaaaggaccggactttcgtgatccgcttgagattgcgaaggtgctcggtccttttattacagccggagcagtctcaccgaatgatttacgtgaccttgccggacgggtgcttggaaaaacactggaggagtggccggaggacatttataaacggcctgcaggacaggatgcggaaaagacaaacctgactgcgctcatgcaggagttgaaagaaagcatcgaagatatcaaaacgtcctgaagggaggtgaatcaagcaggtggcgcgagaattaagaaatgccaaaatcagctttgtcagttatgtggacaaggcggctaaccagacagaatttttctttacgaagtcagccaaacctccgtcatttgaaaaaaaggttcggctgtttacaaaaagtgagcaggatgaacaaaagctcgtgtacggaatcgtgtatgagcctgatgttcctgatgcccacggcgattttatgaccgccgaggaaattgaaaaagcggcgcacggttttctcgcggaggcacgggagattgatatcaatcacagcttcgagggcggaaccggcgtcgtggtcgagtcctatgtggcgcccgatgattttatgatcgggtcaaagcggattacaaagggctcatgggtgctcgtgacaagagcgtcagacgaggtgtgggaacagatcaaggctggaatcatcaccggctacagcatggcgggcactgcagatgtatatgaggaagaaccggttgaaaaagcgggattcttcagtgtattcaagcaaatgcttgctgacaaaacagggaaggagactgaagaaatgagaaaagaagacatgaaagaatcattcgagcatgcgctttaccctctgctcaaacggcttgagcggattgaaaaaaacacagacacggaggaaaagccggagcagacgggtgatgacgagcgtctgaaaaagctcgttgaagacatgcttgccccgctgatcgaacgcatcgaggctttggaaaaagcgcgaggcgcgtctaagcagacagcggacgatacgggcggcaatacagagcaagtcaaaaaatcaatctggagcggactgctgtaaaaccagtcaaggaggaggaaatcaattgagaaatcaagagatcattcggaaagcggaaatgtcgctttctgctttaaaaagcggcgggcttatgaaccctgcgcaagcatcggcttttatccgcatggtgcaaaacacgccgaccattttcagtgaatcccgcgtgattcaaatggaaaatgactcgcaaaaatttgagaaaatcggcttcggccagcgtattctgcgggctgcgcaagaaggaaaagcactgtcaaacgacgagctgacagttccaacgacaagcactgtccagctgaacacgaaggaagtcattgcggaaatcaacattacgtatgacacacttgaaaacaatattgaaaaagacggcctgcagcagacgatcatgcaaattttagcagagcgcgcagcagttgatattgaagagctgatcgttaacggcgatacagcatcagctgatccgtatctggcacagctggacggcatccgcaaacaggcggtttcccatatcgttgacatgaacggtgaagaactgtccagagcgacatttaagaaaggcttaaaggcagttccgccaaaatatttgcgcatccctcaggaattcagattctatacgtctcacggcttagaagttgaatggaaggaccgcgtggcagaccgccagacaaaccttggggaccaggctgttcagggcggcttgtcaacagcattcggcgtaccggtcaaaggagtatccaatattcagccgtacacagtcggtgagggagacgcgcaatatgacgcttctgatatcattctcacacatccgaaaaatatcattctcggcttctcccgcaatatccgaattgaagtcgacaaagacatccgctcccgtaaatttattattgtcttaacggccaagctggacagcaagttcgaggaagaggatgcctgcgcaaaattaattaacgtaaaagaataatagaaacgaggtggtcagctcatgctcattgaaccgactgacgtagcctcctattcggtctatgatcgggtgaaaaacaggccggaagagctgctggcgcaggatatcatcgaggcggaagcagaagcggctctcatcacgggccaccgctttgaagacagcttgtatgatccgctgcccggcaaggtgaagttggctttagtaaagcttgcccagtattttgcgcttgtcaacagcgatgaatctgcctcatcaagctatcagtctgagaaaatgggggattattcctacacggtttccggagaaggcggcattcagcggccagaggtatatcatttgctcgaggagtttatcacgccgggctacgcccctgaatcctccagactgaaggtgaggtctttatgagctacaggcagatgctcattcatcgctgcgacatttatcatgaagcagcgcaagcgccgtctgcaggccgatttgggattccggcagacaggctgcagccggtgatttcatatccggatacacccgatgaacaagatgtcccttgttattttaccgaaaaaacgcagcagctgattcaggaggagccggatcaaactgtatatcatagctttctcgtccattttccgttgtcagcggacatccgcgtgaacgataaaatcatttgggagaatcataaatatatactaaagctgccgaaaaggatcagacatcatcattgggaggtcgtcgcagtcagggatgaaagcctatgaaaatagcgggattgaaacagctgaacacggcattaaaagaagcggcttcaggcggtttttccagacaggcgtcccggtggcttgaggagtgcgggcaagattttctggagatcgtcaaatctgaactcatcagcacacaaacgattgatacagaaaaactgctcagttcctttgagaaaggcgcagaggacaatctctggattgtgcaaagcggcgggctttcgcttgaggtggggacacagcttgattacgcctcatttcttaatgacggccattggacgtcaaaacaagatgtgagatgggtgccggggcgttttcaaggctcacggtttatttatgatccagccgcttcaacgggaatggcgctcaagagaaaatggataccgggcacgggctactgggatcatgcactgcttttatatgaacagctgtttgaaaaatcgctggaaagcaaactgcgccagtggctgaagaagctgtaaaggaggagcaggatgaacagtgaaacaggatcgatcatggcgtttttgtacagccggtggtctgttcccatttatgaacgcgagcttcctgatcactttcaggtgccgtcgttatacgtcccgccaccatctgttttcgaggaaacagatacggtctccacatttaaaaaaacctacagtctcaatgtaaaactgtttcatctggactccgttcaggcgctggatgaagcggacaggctcgcggatgccatcagagaagcgagaaatatgattccgctgctgagtgaatccggcgagaagacgggggatatggttcgcatctcccaaatcgagacaagggtaggggacaggggcgaggcggccatggtgatcaggtggagcagccgatattattatcacaaaacagaacagcctgtcttacaggatatcgacatgaacagcggggtgaaataaacggtgtcaaaggacaaacaacagaagaaggctgtacatacaaagagccgggaagctctatttgatacagcggatttgattaagcacgcgaaggaactgttcggcgttaagccggatattcttcagggggctttatttggcgtggatcaaccacgtatgacgaaatcagaagccaaccaattgattcaaacatttctaaccaaggaggtcatgtcatcatgaatggcggaacatttacaacaggcaaagaaaaagaacgtgcaggtatttattttaactttaaaacgacggcacaggagcgggtatcactcagtgaacggggaacagtcgcacttccggtcgcatcaagctggggcgaagcgaaaacgttcgtctccatttccagcgttgaagacctaaacaaaaaagtgggcctcagcattgatgacccgtctttattgctgctgcgtgaagcgaagaaaaatgcgaaaacggtattgatgtaccgtctaaccgaaggtgtccgagcgtctgctgatattgctgaaggcgtcaaagcaactgcagtatatggcggaacaaaaggaaatgacattatcatccgcatcaatcaaaatgtgctggatgctaattctttcgatgtgacaacatatatggacgaatcagaggttgataaacagactgtcaaaaaggctgaagaattaacagctaacggctatgtcacttttaccggaacaggcgatctttcttcaacgattcctctcactggatcagaaggagacactgcagctgagacgctgaatgcatccgcgggaatccgtttatctggcggtacggataaagcccctgtcaactccgactatacagatttcttagccgcggctgaaacggagagctttgatgtgattgcgctgcctgttgcagaaggtgaccagttgaaggcgacgtttgctgctttcattaaacgcctgcgcgacggccaaggacaaaaagtgcaaggcgtcacagccaattatgccggtgattatgaaggcatcatcaacgtaaccgagggtgtgctgcttgaagatggcacggaagttacaccggacaaagcaacagcttgggtagctggagcgagtgcaggagcaacctttaaccaatcactcacatttgtagagtacgaaggcgccgttgatgtgttacaccgccttgaccacgatacgattgttgaacgtctgggcaaaggtgaatttttattcacattcgacgcccgtgacaaatccgtcagcgtagaaaaggacattaactcactcgtgacgttcacagctgagaaaaacaagaaatttgcgaagaacaaaatcgttcgtgtcctggatgctgtgaataatgatttaacacgcgagctgaaagccttaattaaatcaagaaaaggcagcggaagcgatatcccggcatctgaagacggactgcagtatgtaaaaacgatgatcacgcaatacatgacaacacttcaggatgcaggcggcatcactggctttgattccgatgaagatatcacaatttcaatgaatgaagatcgtgacggcttcttgattgacctggctgtacagcctgtcgacgcagcagaaaaattctactttaatgtggaggtaaactaatatggcattaaaagcacaaaacacaatctcaggaaaagaaggccgcttatttctcgatggtgaggaaatggcgcacatcaaaacatttgaagcaaacgttgagaaaaacaaatccgaagtcaacattatgggccgccgcatgacaggccataaaacaacaggggcaaatggaacagggaccgcaacgttctacaaagtcacatcaaaattcgtgctattgatgatggactatgtcaaaaaaggcagcgacccttatttcacgctccaagctgtgctggatgatcaatcctcaggccggggcacagagcgagttacgctgtacgacgtcaactttgactctgccaaaatcgcaagccttgatgtcgattcagaagcgttagaggaagaagttccatttacattcgaagacttcgacgtccctgaaaagctatctgacacgttttaatcaaagctgaatcagcccatacgtagacctttctcagaaaggtctgttttttaaagatgaaaccaaacaatagacaagggagttttttacatgagcgagaagaacgaaaacgtatatgatctttccttttttatgccgggaaaaacaattgaagctgaggaaatcaaagtgccgatctcaaagcgttttgttgataaaaaagggaatgtcattccgtttattttaaaaccaattactactgaacggattgatgaattagagaaagaaaacaccacatttaaaaatgtgaaaggccgcggccgcgtcaaagatttagactcccagcgcttttatgcgagaattgccatcgaatctactatttatcctgattttcgttcaaaagatttaagggaagcatacaaaactgcggatccggtagaagttgccaaacgtgtattatctgttgggggagagtatgcgaactggctgaataaagcaattgaaatcaatggttttgaagatgatcttgaagatctagaagaagaagcaaaaaactagtaaaggatggcgataaggaagctgtgtatttgtactatgcaatgcatgagcttcattactcgccatcccaacttcttgaattatatgaagcaccaaaacattttaaagctcttttatttgggttgataggttataagctagatctattagaaaaagaatcaaggagaggagggaactaatatcgcaaaattaacagcccgttttgatctcgaagacaaggtatctaaaaaactaaaacggatacataaaggattccaagaggtcgaaaaaaaagtcaaaaccattaatcggcaaatcaaaatcagtatcagagcggaagatcaggcattttaccggctgagaaaaataaacgactatatcattttgaaattcgcgaaatcgcttgagattaaagttgtacttgatgaccaagtcacatcaaagcttgatgcaattgaaagaaaacttaaacggctgccgaaagaaacgaagctgactgtctctttggtagatcggacagcagctgcgtataaaaaaataaagaagatgctttctaatcaaaagctatcattccttttgattccagatgacaaggttacttctacagttaaaaggattatcggttatattaagaaaaatttgaaaaacggatacacagtaaaactaaaggtcatcgatgaaatcaccaaaacagttaatcgattaacagcccttctaaggaaatttgaaaaaacctattatgtaaaagtggttgttaagacaaaaatatcagacaaaatcaataaaaaagaaagcccgattaacaaagaaacttctaagaaagaatcagacaaatcctcagataaaggctctgataaaaactcagatcaaaaacctggatgggtcggaaaaataaaaggctggctgaaggattggtggacaaaatcagcttggccttggatcaaagatacgctcaatgaaataggcaaagcttttttggatcgtttcaaagagagattgatagaaaagctgaaaaatgatgtgtttgataagatcattgataaaattctaggaccacaaaaaaaggacgattctggtgaaaattctgacacagataaaaaagtccttaaccgtaatacaggaggaaattgttgctgtgactgctgtgaaggcggtatcagcccgggcactaaaaataaaaaaacctatagaaaaaagaaaagtcccacaaaggctccaaacagaacactcaaggttcctggagaggtgataagaagacgtcaaagcggcacacctgctgaaagtgcacctaggacctcgggttccaagttaaagaactggcttggaggcttaaaatcgctagggaaggattcatccaaactaggtaaagcgttcagaggaatgggaaaggctgttccatacgtaggatctgctttagcagtgtttgatttagctggaatcaataaagataatgctggcgaaaaggttggttcaatcggaggacgcattgccggagcggaagctggtgcaacagccggagcggaagctggtgcaacgattggatctttcgttggtccggaaggtacagcaatcggcggggcaatcggcggaattggcggcgggttagtaggcggaatcggcggcgaagaagcaggtaagaacattggtaagatgtttgatacttctaagttaaaggagagcataagcaattcactatttaacaaagagtggtggagtggaaaatggaactccatttctgatactgccaatggggctattacttggattgaagatacatggagtaaagtttcaacttggtttgaccagtatgtgtttacacctatatataatgttgctgtacctgtaattaattttatagtaggattgtttgcctatgcatgggatggcatattggcagtatggaacattgtctacccgtggtttaaggataacgtgtgggatccaataagcggagcagttactaatgttgctacaacgatatggactggattgtgcaacgcctggacggttatttcaggcatatggtctactgtttcaacatggtttatggacaatgtgtggaatcctgtaagtgaagccgtaaccactgcggcaacatggatttggagtaagatcaatgatgcatggacaataatttccaatatttggacaggagtatcgaattggttttatgataatgtatggaacccgatcgtcaaaaaagtagaagatattaaaacttcaataaaagaaaaattcgatgatgcaaggaaattttttgaggatgcatgggatggaattgaaacttggtttaatgaacatgtgaaagatccattggttaaagtatcagagaaaattgctgagaaatttcaatggctattcgatttaaaagattcagttggtggtttcgttgcaaaagtaatacacaggggggaagaagttactcacctcaagaaaaaaccaatcaaaaaggattcgaaagagaaaaaaactagttccaaaccaactactaataacatttttgctcaatctccatcaaataataatatgactgtttttcaacaagcactagatcagaacgccacaggcggctacatcaccaaaccaaccatctcgtggatcggtgaagccggcaaggaattcgttatcccggttgataacaaccgaggccgggggaagatgcttctttcacaagcggcgtctaagctgggtatgcaagttgtagacgacatgggcgcagcttcgtcttctggcggaagtccagcatctgtttcaggaggagcagctgtcagtcctctatcaggcacagcctccccagtaatgaacactgcaaatcttacaggccaagcgtccacactcggacagcaattttcagaaggctttggtaaaggcatcagcgatcagccggtcaaaatggaagactggaaaaagaaaaacatcaatacgccatttacacaaatgatttctgcttcaccaaattacggtaaacaaatggtaagtgggtatgccaagggccaaagcggcactgcaaccggaacagacggctttttgcaatcaaaagttaaaacgccgttccaagccactgtgagcaaatcgtcttcatggggcacaggaacggtcaaaggctttgcgcaaggacaaaattcaacccaaacagggactgcacagtatgtgagtacacatgttgacaaaccgttcctgcgttcaaaagacacatcgaacagctggggctccggtttgattggaaactttgtgacaggcatgaattctaaatccagtgaagtaaaacaagcagcaaaggatatggccaagagagtggagcaggctttccgtgaagaattagatatccattcaccttctcgtgtcatgatgagcttagggcgttttgcctccgttggtgttgtaaaaggtctggattctgtcgatgtgaaaaaatatgctgaaaagcaagctggatcactggcagctgcttattccggaatgggtgcagtaggtggaaatgtgaagcagtggcttatggctgcaatgatggccacaaaaacaccattaagctggcttccgggattgatgacaattgcaaagtttgaatcaggaggcaaccctaacgccattaacctgtgggatagtaacgcgaaggcaggcaatccatcccaagggctcatgcagacagtaccaaccacttttaacgcacacaaagcgccaggcatgggtaacattagaaacccgattcataacgctgctgccgcaatcggctacatcaaaagcagatacggctctattgacaatgtacctggtattaaaagcatgaagcatggcggaccttatgtcggttacgcaaacggcgggctgattacaaaagaacaaattgcacgtgtcggtgaaggaaacaagcgggaatggatcatcccagaggaacgtggcatccgaggccgctacctccttcagagagctgcgcaagctctgggaatggaagtgacagatccgtctcaatcccagcagtctgagctttcttcaggacaagtttcagcagttacatccggtacacggcaaacgatacaaacagccggaacgaaagaaataaagattgagtttaacggagaccagcatttccataatggacaagacgccgaaagccttgcagcgaaaatcaagcaggcgcttatagatgaattgcaaaaggatatcaatattggaacgaagggagtcgttgcatttgactaaatccgtatatgaattttggatttcacaagggaaggacaagttgcggctccccgttcttcccgaccagctgaatatttcaaatacgattcagaatgagacggttaaagtagccaagttcggtgaccttacatttattgacgaacaaggagcgaaagaaatttcgttctcttcgttttttccgaagaaatacagcccaatagctgaatatcaaaccttcccgtcgccggaaaatgcgataacaaaaattgaaaaatggatgaaggccaaaaaaccggttcagtttttgattacgggaactaaagtgaatttaacatgcagtattgaaggtttttcctatagcgaaggccagcaggatataggtgatcgttcctttgatattcaattaaaagaatacaaaaccgcttccccgcggaaaatcaagcagaagaaaaaaacaaaggcaaaacgtccgtcgaaggctgcgccgaagacgtacacagtgaaaaagggagacacgctatgggacattgcaggcagattttacgggaacagcacccaatggcgcaaaatttggaacgccaataaaacagcaatgatcaaacgaagcaaacggaacatcaggcagccgggccactggatttttcccggccaaaaattaaagataccgcaatgaaacaggtgatgtatgatgatagaactgttcgtcattaaagacacagagtggcttgagctggttgcagaaagcgtatcgcttgaaggccatcgttatcaggcgccgcgttctattgaagcaaccatcgtcaccaagcagggcgaccagacgtattacagtgtctcagaaggagatacggtcttgtttaaatggaagggaaaagagctgtttcggggcattgtttttgcaagaaccccggacgagcatacgcttgccttcagcgcttatgacatgcttcagtacctggtcaaaaaccaggatatgtacgtgttttccaatcagcgggccgaccagatcataagaaggattgcgagtgacttccagataccgacaacctcgatcgcaaacacaggccatacgatcaaaagtcttgtcattaaaaatgatacgacattgtatgacatcatattaaaagcgctgaaacagacgaaaagccagacaggacgacattaccagctgtattcggaaaaaggaaagctcggtctgcgcgcttggccagatccgtcagaagtatgggtgcttgaaacgggcgtcaatatcacgggctaccaatacagcacttctataaacgatactgctactcgggtggtgcttcgccggcagaaggacaataagacatataaagcctctgccaaggacagttcaggcttaaataaatacggtgtgcttcaatatacggaaacggtcacagatgacatcaaccaggcacagcttcagcagcgggcagatgtacgccttgctgaaaaaaagggcgtgaaaaaagaactgaaaaatattcaggcagtgggcattccggaagtgcagagcggcttgcccgtctatatttcgattccagaggccggcatcaagaaaacctattgggtagatacggaccggcatgaatttaaaggaacgaaacatacgatgacgatcgatgttgtcgaaaagaatacgatgccggaaggagtatcctgatgagattaagtgaggctataaaacatttggcagtcggcgcaattgacgctgagtctccggtagaactgctcccggctgaagtcgtttcggtttctcctgtggaaatcaaattaaaagaaaacagcaaactgatcataccggaagacgccatcattatcccaaaacgaatgcagtccggaggagacgatgcactcgaaccgggggatcgcctcatgaccgcggctctgactggcgggcaatcgttttttattttagataaggtatagacaaaccgcttcagtacgaaggggtttttatttagcatgtaaaaggagtgggcatcatggccctgacaccagaagtggagtttgaagatattgaagatgtgagtgaaatcattgaaacctcgcaaacgtacaaaatagattttgaaaacggaagaattacgaatgagctgattaccgggcttgaagcgatcaggcagttcgtgtatatcgccttacagacagaacgctatgcgtattccatatacagccataatgtcggaaacgagcttcaggacgtgctgaccgatcatgagacaactgatgcctataaaaagatggagatcccgaggctgatagaagaggcgctggtttatgatgaccggatatcggctgtaacagattttgagattgaaaaacaaggcgacgcgtttcatgtgtccttcgtggtggagacggatgaaggaacgcttgagattgaggaggtgattggcgaagatgtttgaagatcagacttttgaagcgattatggagcgtatgctgaacagcatttccgcagatattgacacaagagaaggcagcgtcatttataatgcgttagccccggcggcggccgagcttgcgaagtcttatatatggctggatactgtgcttgagctagttttttctgataccgcacaaggcgaatttttagacaggcgtgcagcggaagcgggaattgaaagaactgccgcgacaaaggctgtcagagcgggagagtttacatctggagttactattcctgtcggctcccgcttttacgtggataatctttattttcaatatacggcagacgggacgctcatctgtgaaacacctggtgaagcaggaaacgccaacctgaccggacgcaatttactgtcattggataccattcccggtttagaaacggccattgtcaaagaaatcctgattccggggcgcgaagaagagggagatgacagcttgcgagaacggtattttacaagggttcggcgtgaggccgtcagtgccaataaaatgcattataaagagtgggctgaggaagtggacggtgtgggaaaggcaaagatcttcccgctttggaacggtgaaggcacggtcaaaattgtcgtcaccaatgcgaatcttgagcccgcttctcctattttaattcaaaaagtgaaagattatatcgaccctgaaccaggacagggagagggacaggcgccaatcggagccgttgtcacagtggagagcgcggtctggaaagaagttgagatttctgccgaagtgctgcctgagatcaatcactcaattgatgaagtgaagtcagaaattgaggaaggcgttttaaatctctttaagaaaatggcgtttgaagataacgtcatccgcctttctcaaattaacaatatcgtctataattcaccatcagtcagtgactactccaatattcaaatcaacggcacgtctgaaaatctggtgttgagcgacgtggaaattcctaagcttgggcaggtgaagatcattgagcaaacaagatgacatgcgagcttatctgccgccgtttctcaccagccttaaagaaatggctgagctgctgaaagcggaagcgcctgagtttgataaacaaaatgacagcatatttgatctgacggatcagttattcgtgccgacggcgacatgggggctcagccgctgggaaaagattttaaacgtaccgcgggaatcaggtgacactgatgagatcagacgattgaggctcatttccaaaatgtcgaacatcccgccaatcacatacagggccattgagcaggcggtaaaccgtttcttgaaaaacccgtctgcacaggtccgcctgattcccggcgaataccgatttaacgtcgatatcaatgttgatgacctccagcacatgaatgagctgatcgaagcgatagaaaacatgaagcccgctcatttggcgtatacgctcagaggcggattgaacgagacgctgcaaatcaaagacacagttatcctgaatcatcgcagataccgaacagccagtgagctcaaggtcggttattctgtcactcttaacaataatgaggtggtcttaacttgatttcaaccatatacagagaacgcacagcggctgatctaaaaagcagaatcgatcacgtgctgctcaacggccaaaaaacagaaatagtagatctcaccattgacggtgcgaccgtcaccattctgacaaaacgtgaggaagacatcaagcatatcgaaacggtacaaatttttgacgagctgggcaatgtgatcacagagagaaagactgacctggacgtcagcgaaaacagaacacttgatttcagatttacttttgaggtggtgtaaacatggcatacgaagaaaaaacagactggcttccggacgaccccatcaacgaagatgacgtcaaccgctgggaaaaaggaataaaagacgcccacaccgacctggccgcccacaaaaacgacatgaacaacccccacaacacaacgaaggcgcaaatcgggctggggaatgtggataatgtgcagcaggcggcgaagaaggattttgacaagcatgtgaatgacggtacgattcacattactgctgctgaaaggtcaaagtggaacaacgctcagttaagtaagatatcaggtgatgatggaagggtcttttacaagagtgtgaccgaaattactgattataatgatttaaccgatactggtatgtacttaatatacaatgacggcttgaagggtccgggcctaaatcagtgttttctccttgtgatgagctataaaaacacacttgttcaaatagcttatgacggaattaagggagagcagtcattttttagaataagaaaaaacgattctacaacatggacaccatggattgaatcagaaactacagaggggtctcaaaagaaaatagatgcacatgctaataaaacagatatccacgtaacaaaatcagataaagacaagtggaacgactcacagctctttaaaataactcaggataacggtctcgcaaagtactgtgaagatgcagatttcaatactgtcatcgaaactggattctattacatgagtggtgcgacaacaacattaaatgctcctgttaataacaatggttatttaatggtttataatttcagcacgtatgcatatcaagaatacacgtcttatagcagtagtgacacaatatcaactggccgaaggaaattcatgaggaataaagtggctaactcagacgtttggacatcttggcgtgagatcgaatcggttgaaggctcacagatcaaagtagatgcacatgccaataaaacagatatccacgtaacaacatccgataaggacaaatggaataatgcacaactatatagattaacagatactcaaggttgccgaactaaaatcccagatgggactgacttgttaacactaccctctggcttttactatgcattagggaacgtcataacaaataatcctgtttcaggagatggatcatggtataactatgatgttatcgaaacagagggaggcggacgaaaaacaattttggcctctagaagttatgacggaaccttttggacggcaacgatccatacagacggcgtgtttaaaggctggaataagatcgagactgaggtaagtgctcaaaccaaagcagataaagcgctagctgatgctaaaaactatgttgactctaattatacgaataataaattaacagttcttacaggctctaatgcaatacaagacgcaagaactggggggaatgaatatcctccagggttaacactaatggatattggtcaaggaaatactacaggttatccacttggttatggaattgtaaaaaatgagaaatacagtgattttagatttactcaatatttttacggtacaggaaatgaatcaaatagttatattgatagtactggaacgtgggttcgtcactggtggagtggttccggctggactgcgtggcaaaagatatcagggtttgctcacgctaatattgggactactgggcgtcaagctcttattaaaggagaaaataacaaaattaaatataaccgtattataaaagatagccataaattgtttgatacaaaaaacaataggtttgtagccagtcatgcaggaatgcatttagtcagtgctagtttatatatagaaaatactgagcgatactccaattttgaattatatgtttatgtaaacggcacaaagtataaattaatgaatcaatttagaatgcctaccccttccaataacagtgataatgagtttaatgcaactgttactggatctgttacagttccgcttgatgcaggagattatgttgaaatttatgtttatgttggttattctggagatgtaacacgatatgttacagattcgaatggagctctcaattattttgatgttctggagcttggcggaagaaattacccgagagtttaggaggtacctttatgatcttatatgatgccattatgtacaagtatccaaacgcagtatcgagaaaggattttgaattgcgtaatgacgggaacggttcatacattgagaaatggaatctccgggcgccgttgccgactcaggcagaactcgaatcctggtgggaggaatcacaaaaaaacccgccgtacgagccgcctgatcaggtggagcttctcgctcaagaattgtcacaagaaaagctggcacgcaagcagcttgaagaactgaacaaaactttgggaagcgagttgtcagatataaagctttccatactttctttgaaaggagattactctgaatgaattattgggtgcttgccctctattatgagtgggcgacaacggatatggtgaaacaggccttagcatatcaagactgttcaattgaggatctggcagagggtgtgaacaaaaagctgatcacagctgaccagtataaagaaattaccggtaaagccatgtagtaaggcttttttattttgcctgtttttagatcaaaggaggatgaagatggtgaagtatcaatatgaatttcctctcgataaggctggaaaagccggcgctgtaaagccctatcgaggaggaaaaaatgattttgtgacacctgtttcgaatttgtcaggcgtagcggagattttaacaaatgcttccttaaaggcgactgaggcatacagtcagctcgggcaggacaggcttggcgcagttctgatttcgaaagtgaagggctgggcgtatgcagatcgtgaaggtacgctctttatagaagaaagcgacaacaacaatgtttggacaacgacagcagcagttaatgtcgcagcaggtgtcctgacagcgacggactgggtatacctttctaaacgctattaccgtttccgctatgtgaacgggaatcttcagcaatctgagtttgtattataccaatcagtcggtgcgggtgagatggatgtgcgtgtcaatggaaaaacgcctttacagattgactttgcggagaatcaaacacacgatggacggctgaaagtcgaggctcgcaaaacatttgactttgtctttcatgaaaatgcagagtccgccggcgagggtgcttctttacctgttgacggtgccgcgcatttactcgttgaagtatatggcacagcggaaatgagcgaagtcaaattttggggcaaatcggtgtcagggcagaaactgccgatcagaggcgtgaaaactgatgatgccacctctgctttgagtacattaggaaaagctgaggcatgggccttcgatattaaagggtttaaggagatcatcatggagatcgtcagtatcaccggcggtactctctcggtaaaagggaccgctgtttcataacagttttggctctcggaagggaggtgatctgcatgtgaaggaggagtgaataatgcagcaagaggcagatgtgaatgtgtttcagcaggatttagcagacatgaaaggcgagcacaaagcacttgagcagagggtttccgcattagaacgcgtgtctgaccgtcaagaccagcaaatcatgacgctgaacgaaaaattaaacaaaattgaagaaaacactacgtggattaaacgcaccatcacaggtgccatcattacagcagtgtctacaggcatcattggcggagccatcgccattatgtacagcctgctgcagcattaaagggggattttcatgaacacgtttgacaagggcacggtcatcaggacggtgcttcttttaattgctttaatcaaccagaccatgctgatgctcggcaaatcaccattggacatacaggaggagcaggtcaatcagctcgctgacgctctttattcagccggttccatcgtatttacaattggaacgacacttatcgcttggtttaaaaacaactacgtaacagaaaaagggaaaaagcagcgcgacgtgttaagggacaataatctgacgaaataaggagagatgaaaatggttaacattatccaagactttattccggttggcgcaaataaccgtccaggctacgcaatgacgccgctttacattacggtgcacaatacagcgaataccgcagtaggagcggatgctgcggcccatgcccgctatttgaaaaatcctgatacgacgacaagctggcattttacagttgatgatacagaaatttatcagcatctgcctttgaatgaaaacggctggcatgcgggagacggaaatggcagcggtaaccgggcttctatcggaattgaaatttgcgaaaatgccgatggcgattttgaaaaagcaacagcaaatgcccagtggctcatcaaaacattaatggctgaacataatatcagtctcgccaatgtcgtccctcataagtattggtcaggaaaggaatgtccgcgaaaattgttagatacgtgggattcgtttaaagcaggaattgggggaggcggcagccaaacttacgtcgtgaaacagggcgacacacttacatccatagcgagagcatttggtgttacagttgctcagctgcaagagtggaacaatatcgaagacccgaatcttattcgcgttggtcaagtattaattgtaagtgctccatcgtccgctgaagaacccgagctctatccgctccctgatggtatcattcaattgacaacaccttatacctcaggagaacacgtctttcaggtgcaacgagcacttgcggctctgtatttttaccctgataaaggcgctgttaacaacgggattgacggcgtttacggaccgaaaacagctgacgcagttgcccgttttcagtctgttaacggtctaactgctgacggtatctatgggcctgcgacgaaagcgaagatcgcagcgcaattaagctgatcacagaccataaaaatcccggagctgctccgggatttattttttcttcttcaactttttaataattccagcactgcgctccctcacccgaagcgagtacccggaaagcccaaaccttccgtaatcaacaaacttcacacgcctcaccaattttttcactgtatcacctgacattatcctctgtttgtatttattatatgtaaccctttaagaaaaggaataaggacaagagctgttttcccttgtccttttagtgtgatcatgctttttttcgtttatactcgtcaatcagccgttcgttttctttgaagattcttgctgtatgcggactgacttgatagcttgcgacactggtggttgaacgttttttcaggattttaaacggcttcgccgctctgggctcgcatctgttttgaaacgcacgttccattatccttcaccttcctcctcaattggcagcaccaaatcatatatgctcgttaatgacgtaaatagcaaataatcaaattccgtgacaatgctgtcagacgtcagcttgatgacatagttctgtgtctcgatggtaaaagggatgagaaccacttttccgtattggtcgtaataaacatcctttcgatcgagccgtgtttgtacatctgccggatcatccatatgctcggttaaccggtctttatcagcctgtgtcgaatagtggcaaagagaagccgttaagttcattttatcagcataggttttcagcagcttatcaataccttcagcataagcatctatacttccataataaacatggatcggctcgtttttcaataggtattggtatgttttcagccgattgagatacatgtggagcatttcgttgttttcttcaagaatttctcttgtgtctgtttcaagctcgctgccggccagttttttgacgtatgcacttaagaagataaaagcatcaatcaaagcaaaactgactgcgacaatgagataccgttcccagtgggtaaatagggaagtgggctcatatgtccagtataccatagcgcctagaacaaacagcaaataccaagttttccggatggcggacattttttctttgaccttcgcttcgaaacgccacgtggcatatacgtataaccccagtccggccacgatgcaccagaccatgatctgaaagaataaaaccatattcgaatccctcacatttgaaataggttctgcttattgtattcgagagatccggatggttttcctgttccatcaaaaaaaccgctcctttgacagaagcggtgtgacattaaaatatcatatttaaaataaagtaggcgatggcaccaagtgtcgctgaaatcggaagcgtgatgacccatgtaatgagcattcgcttggccgtaccccagtttacaccttttacgcggtgggacgcaccgacgccaagaattgatgaagaaatgacgtgggttgtactgaccggcaaatgaataaacgtggcgccgaaaataatggctgctccggttaagtcagcggaaacaccgtttaccggacggattttcatgatctttccgccaacggttttgatgattttccagccgccgattgatgttccgagacccatggctgtcgcgcaggcgaattgtacccaggtaggaatatcattagcagaagtatgtaaattcgctgtgatgagagccattgtgataattcccattgctttttgcgcatcgtttgttccgtgtgtatacgattgcagggcagctgttacaatctgcactctgcggaattgcttattcgttttcgccaagttgctgtctttgaaaatcagcttaacgatgctataaagaataaaaccaaggacaaaggcaataattggtgataggatcagtgcttcaatgattttaatgaagcccttatagtttaacgctgcaaatccggctgccgcaatggctgcaccggcaatagcgccgatgatggcatgggatgagctgcttgggataccgtagtaccatgtgataaggttccaggcaattgcagcgagtagcgcagccaaaatgacaacagagccattttccagcgtataaggatctacgatgtctttcgtaatggttttggcaacacctgtaaacgtcattgctccgacaaagttcatcacagccgccaatataatggcatggcgcggttttaacgcttttgttgataccgaagtcgcaattgcgtttgccgtatcatgaaacccgttgatgaaatcaaacgccagagcacaaatgactattagtatcgttaatattaatagaatatccatttttacccctcgttacgcgtttttcataatgatggtttcaagattattggcaacactttgacaagagtcggcgatttcttcaagcgtttcgtatatttcacgatattgaatgactttgattggatctgtttcatttccgaaaagattctttaatgattttctgtgcaagttgtcacagctgtgctcatactctttaattttgattgcgtgaggctgaatatcctttaagcgattttctgccagcagctcgatcgtaatcaaaatctctttcgcacattctctgatatatccgctgaatttatcaatatgctcgtctgatgaagtaattgagaaaatctccatcatggcagagaaatgttcgattccgtcaagcacatcatccaagctgtttgtcagctgaaggatatcttcgcgctcaataggagtgatgaacgctttgttaagctctttaatcatgacatgaacatgattgtcaccttttgtttcatattcctttaacgtatctgcaaattctttaagagtcgtttggttagtgaccttaaaattcacaaaatattctgcagtttcgtctatgttctttgcaatttctgttaaaaggagtgagaacttatctttttttcttcttatcattaaaaaccctccatagtttgaatgaacaatgcacacatcaaattattatatagccttttgtcgaaaaaaaacaggtaaagtcgaaaaaaacgtatcttgacttttttgataaatcgtgtctccttattttgacctacttcgctttaaaaaaacgacccaagtttgcaaaaactttctgcttaacgtaaaaagtatatcaaaagttgtgtttttcctgtcaacttttatcttctgtttcaccaaaaaacggttccctaaacaagggaaccgttttatcagcttgcttttcgttttttcatcccgtaatagacaggcagcccggcaaggccgatgaggatggataatccgcagctcattgtatctgtaatgagtgtgctgcctagcacaaagaaggagcccgcgattgccagaattggcatagatggataaagcggaacactgtaggcgcgcttttttccctttgctcgcttgcggagaataaacactgcaaaaaaggccatcacataaaaaatgtagatcatgaaaatggagatttctgagagcttatcagggttgctgatcagcatcataatcaaagccaaagcaatttgaaaagaaatcgcaatccatggtgtgcggaacgacgggtgcacatgtgacagtttttcagcaaatggaagctgtttgcgttccgccattgcaaatgaaacacgcgggaaagaaagcacctttccatttaagcacccaaagatgctgacgataatccctacactgatcagctttccgccaattgacccgaacagcatggttgccgcggtgcttgtcgcattttcaccaagcgtgacaatttcgttcgctgacaggatgtggagcaatgcaaaattaatgaaaatatagatcgctgttacaattaataatccgcccgtcatagcgcgtggcagcagcttttcgggatttttcatttctccgccgagagcggcaaggagaatccatccgtcataagcaaacaacgtagctaaaatagccgccccgaagttcatatcggaaatgctttcgtttactgctgtgaagatgtgctgatcgcctttccaaaggccaaagatgatgatgcaggcaatcggaatcagttttccgatcgttgtcagcgtttggacaaaaccgccatattttgtaccaataatattaatgacgcataaaaagagaactgctatgattccaatgacttttgatagtccagatccccagccgaaaagattcgccattaaagatccaaaatataaacccagcgcgccaataatcgccgggccgtaaatgataatctgcacccagccgcacaaaaatccccaaaactcgccgtacacttcttcaaggtacgtataaagaccgccggtttttggaatctgcgttccgatttccgcgattgtcaaaccgcccgccagtgttaaaataccgcctaacagccaggcgaaaagcgctgtttttgaatcacctgaataagcaagcacagcgccgggcttcataaaaacaccagaaccgataatggttccgatgacaagagtaagggcaaacaagaggcctatctcttttttcaaaccgttgtcttcagtatgcatgtccttaacctcctatgatgttgaagcttcatgttgaagaatctattttttcatattgtaaaccctattttagaaaagtgaaataaaataaattttctgattttcgaaatttgctttgtgtacagcaaataaaactgtaaaaacgcttgttttaacaatctataaacgaataaacttcatgatttttatttgcaaagttcgtgttttctgtattaggattttagccggtacggaggggagaattcagaaaatgaacgaaccttcggtgaagctgatatgttgactttctcatgcgaataaaatactttgttattagaacaataaatatacaactatgatatgatatctcgaaatcgagataaaataacctggagggacagcgtatgaaagttaacggcattcaccacgtatcggcattaacggccgacgcacaaaaaaacttggatttctataagaaagtattaggattaaagctcgtcaaaaaatccgtcaatcaggatgaaccgacaatgtaccatctgttctacggagatgaagtggcaaacccgggaactgagctgacgtttttcgagattccccgcattgcaccgtttcatgcgggaacaaacagtatttcttctattggattgcgcgttccaagcacagaagccctgcattactggaaagaacgttttgaagcgcagcaagtaacgcacagcggtatatccaaaagagctggacgtgacatattggcatttcaagatcatgaagggcagcgacttgtgctgactgctgatgaggaaggaaaaggatatggcctgcctgttaaacagagcggcattccggaaaaattttcgtttcgcgggttagggccggttgaactgactgtgccatatgctgaaccaactttacacgtattgacgaatattcttggatttacagaaatcagccgtgaaccagtcgaagggcaaggaaccgccgttattctggaatcaggagaaggcggtgctgcaacggaaatccatttaatagaaagaaacgatcttccgcgcgagcgtcaaggcaaagggagtgttcaccacgtcgcatttcgggtaagagatgaagaagaacttgccgggtggcaccggatcatcagccgcgaaggctttagcaattcaggcatagttgagcgctactatttcaaggcgctgtatttcagagaaccgaacggcattttgttcgagttatcaacagacggaccgggctttatggtagatgaaaatcttgatgagcttggccaaacgatcgctcttccgccatatcttgagcatcgaagagctgaaattgaagcgaaattgaaaccgatccaataaattgtgattcatttgccctccggcgcgccggagggcttttttattttgggaaaacgcatcgccgattacgatttggagaaagggctagaaaccagctgtatataggatgattggcatgaaatggcctcggcaaaaatattgtctttgtttattaatagtttattcatatttgcttgttacactatttccaagttagccaaaaggagtgaaaaacacgtggaaaagaaaaaacgcgagctggatattttcctcatcctcattttgctcgcatctgcattcttaaatatctataacatctggaatgatgatacggtgaatccttattacaccgctgcagtcacaagtatgatgcaaagctttcataattttttctatgcctcattcgacgcggcggggtttataacggttgataaaccgcctattacgttccagatacaaaccatcagcgcacttatattcggtatgcacggctggagcgtcatcctgcctcaggcacttgctggtgtaggttctgtccttttaatgtatctgttaataaaaccgacattcggtaagacagcagcaagaattgcctctttcatcatggcatgtacaccgattgctgtagctgtagcacgtacaaacaatgttgatgcattactggtatttttcttattgcttgctacatggcttctctttaaagcgatcagaaaaggaaagctgatctggctgttagcagcatttttcgttgttggagtaggatttaatacaaaaatgctgcaggcttacatgattttaccggctttcttattgttctatctgattgcggcaaacgccacaatcaagaaaaaaatcgtttcattggtaagtgcgttagccgtattagcagccgtttcgttatcgtggccgctcattgtcgacaatatccctgcaagcaagcggccttatatcggaagcagccaaaccaactctgttttggaattggctttcggctataacggaatccagcggctgacaggccaaaattcaggcggcggccagggtgcgccaaacaaagacgcttcaaaagaaatgtcttcttctgataacactcaagcaccgcctaatcagtcatcaagcaacagctcatcaagcgatggtaaatcctcaaatggcaatatggcggcgcctccatccaatggccaaatgccaagcggcggtcaaggaggccctccaagcggcggagatggcggccaaggcggacccggcggagacggagggaaaggcggtacaggaactggttcgaaaatgcaatcaggttcagggatgtttggaacgggaacacctggtccactgcggcttttccaacaagagttatctgatcaaatcagctggcttctgccatttgcgatatttggaatcgcaggcttactgatcgctggcgcgagagaaagaagaagattatctatagagcagaaggaaacggtgttctgggttgcgtggcttgtaccgattgccggattcttcagtgtcgcagaatttttccatcattattatctcatcatgctggcaccgccgattgcggctcttgtcggtgcggggtgggttgctcttgttcatctgtaccgcaatcagacaggctggaaagcatggcttttgccgggagcaattattgcgacaactggatttgaattgtttattctcagaaactacaacgatcaaatcggtgcaggctggagcatcggtgtaggtattatcggcgcattgtcagcgattgctttgctgctgtttaaacagcgccaaaaaccgttcagttattatgtttcacttgcagctctcctcgcattgctggtgatgccagtttattgggcaagtacgccacttctgtacggaggcaacagctcactgcctgaaacaggccctcagctcgcatcaatgggcggaaaaggcatgggaatgtctgatgcgactgtaaatgaaaaactgatcaaatatctagaggagaataactccggagctgaatacctatttgccacaaccgattcgaacacagcggcaccatatatcattaaaacgaaaaaagctgtcatggctattggcggatacagcggttctgacccggcgatcacactgactcaattcaaaaaacttgtaaaagaaggaaaagtgaaatacttcttggcttctggaatgggaagaggcggaaacaatgacattgttgaatgggttgagaaaaatggaaaagaagtagcatcagaaaaatggcaatcaagttctgatcaaaaaacagaaaatactgattcggctgatacatcaagcagcaaggcttcaggtgaaaacggcaaaatgggcggacctggcggaatgaatcagtcagcaacattatacgaactacatgctgataaataggaggcaaaaacatgagcagacatattcaatattcaattgttgtacctgtgtataatgaagagcttgtcattcatgaaacctatcagcgcttaaaagaggtcatggatcaaacgaaggaaaactacgagctgctttttgtcaacgatggcagtaaagaccgcagtattgagattttaagagagcacagcctgatcgatccgagagtgaaaattattgatttttcaaggaattttggacaccagatcgccattacggcgggtatggattatgcacaggggaatgcaatcgtcgtcattgacgccgatttgcaggaccctcctgaactgattttagatatgattgaaaagtggaaggaaggctatgaggtcgtgtacgccgtgcggactaaacgaaaaggggaaacctttttcaaaaaacaaaccgcggctatgttttaccggcttctcagcggtatgacagatattgatatcccgattgatacgggggattttcgtctcatggacagaaaagtctgtgatgaaatgaagagattaaaagaaaaaaatccatttgtcagagggctagtcagctgggtgggctttaaacagacagcggtcgagtatgtacgtgatgaaaggcttgccggagaaacaaagtacccgctcaagaaaatgctgaagctgtcaatggacggcatcacgacattttcacataaaccgctgaagctggcaagctatgcggggattttaatgtcaggtgctggatttctgtatatgtttatcgtgctgtatctgaagctattcacagacagcacgattaccggctggtcatcacttattgtgatccagctcctgttcagcggcattgtccttctgattttgggcgtgatcggcgaatatatcggcagaatctacgatgaagccaaagacaggccgctttacatcgtccaaaaatcgtatggaattgaaaataaaagactctatagagaccagcatatgtcataacctcaaaccccctgtccgtaatggacaggggtttttatgctctgagcccgatctaaagcaaaagatgctgatagatatatggaaattgggtaaagaagagattgtgagcttgtactgcggttcagtcatgccgaaataaaaacagcaaaacttaaagatttcgtcatcggctttgctgcatgtcagctgttatattggggggcttttaagaaacgcatgattagagccgtaccagttatgtttaatagaatactggtacccaatacaattccccacgtcaacgtcgattcagagagaagaaagctcagtaaaagaaaagccaatcctgcgcagatcatactcagtcccacggttttcatgttcatgcctcctagcaaacgatgtttctagcatctgatgtgaatgatgtcaatctgtatgatatacggatatctcgtcagaaagtttcatagagcaattaggtcttttatctaataaaaagcctcagaccgcttttacggcctgaggcattatgtcttacgaagttttctcttctttttgatccagtttaatttttttcgtcatttctttgccgtttcggagaattttcacttcaacggtatcaccgatctttgcgtctttatataagatattgcgcaattcactgcctgtatcaatttctttaccttttaggccgatgataatatcctccgcttttaatccggccttttcagcaggagagcctgaagcgacctcacggatgtaaacacctttattcagctggctgccgaacaggccgagtgtgccttcttggtaattttgcggcacttgttctagatcaagcatgctgacaccgatatatggacgttcaatttgtcctttagacagtaattcttcagcaatcggttttacgtcattgcttggaatggcaaatccgataccctcaacatcatcttcactgattttcatactgttaatgccgacgattttgccgtctgtatttaacaaaggaccgccgctgttacctggattaattgctgcgtctgtctgaatgacgttaatgctcgtttcgccggctgatgtagacattgaaaccgttctgtccacgccgcttacaattccttgtgttactgtgcgggacaggtcttttccaagcggatccccaatcgcaataacggtctcgcctgttctaagatcagatgaatcaccgaagtttgccacttttgtgacgtggtcatcactgatttggaggacggctaaatcagttaacgagtcactgcctaccagctttgcagtaacctcagtgccgtcatataaagataccttcagtgatgatgccccttctacgacgtggttatttgtaatgatataagccttgccattctcttttttgaaaatgacacctgaccctgaaccgctttctgtatcttcgctggaatcagaagaactagagccgaacaaagagctgtttgattgtgcctgaagatttgtaataccgacaatcgctggtgaaaggtcttctaccatatctgagattttagaagagtcctcgctcttgaatgcagatgagctgcttgagctttttttagattcagaggaggtgcttgttgctgtaacagattgcgtttgctgctggctggatgattgttttgcagtgtcctgagaatcatggtcgccaagcggtgtaaacgtgtaaatgccaagggcaagactgccgccgatcactccgccaagcaacggtctgaaccatccgaagcctcgttttttcttctcctgatcatgaatgacattgcgggccgagtaggaggtgctctgatcgttctctttcgttaaaaagacctcattctcattacctttcgttctgttttcatcacgatagttatccatcatgttcactccgtttctctattttcacatgtctatttatattgataggtttatgacttgagtttatcataaacaaaaactgtgggataaaaatgaaaagattatgggaaattgtgaaaaagtgcggaaaacggtacacttcatattgtatatgaaaggactgagtcgatggaacagattggattgattggatatggcagcatggcggatatgatcgccagacagctgttgaaacatgaacaaataaaagagaatgagctatttattgagacgagaacgaagggggagcggctgcgggcactcatgtcagattatccaaacgtatcggctgatccgttggagaattgggcaaatacgtgccaattgattttgatatgcgtcccgccgctccatgtcatcgaaacaatgcgccgtctgcacccgtatgtgaacagaaatactcacatcgtatccatagctgccggtgtgccgctgcgtcttttggaggcagaaacagaagccggtatctcacgtgttattcctgccattacgtccgaagcagaagctggcatctcacttgtcgttcacagtgaagcactggctgcagagaaaaaagaatatctgaatgaattgttatcggttttcagccgtgtacgagaaatcaaagaatcgaatttagatgcggccagcaatttaacgagctcggcaccaggattcatagccgcaatctttgaagaactggcactgtctgccgtcagaaacagcagcctgtccaaagaagaagcctttgattttctgattcattcgctatacggaactggcaagatgctgatcgaaaaaaatatgtctttcgaggagacgctggaacgtgttgcaaccaaaggcggaataacgggagagggagctgaggtgatacgcgcctctgtgccggacgtttttgatgaggtgtttgaaagaaccctgaaaaaatatgaactgcttacagaacaggttggtaaacagacatgaatccttgaaagaggattcttttttattactgaatggttgagattttccccagttatattgcatttttcctctttttttaatataatctgttagaatattcataatttagtaaaaaaggaggagcgttatgaaattgtacatgtcagtagatatggaaggtatttcgggtcttccggacgatacctttgtggattccggcaagcggaattatgaacgcggacggcttatcatgactgaagaagcaaactactgtattgctgaagcgtttaacagcgggtgtaccgaggtgctggtcaatgacagtcattcgaagatgaataatctgatggttgaaaagcttcaccctgaagcagacttgatttctggtgacgtcaaaccattttcaatggtggagggactggatgatacgtttacaggcgctttgtttctcggttatcatgcgagagcctcgactcccggtgtcatgtcacacagcatgattttcggcgtccgtcatttttacataaacgatcggcctgtcggtgagcttggattaaatgcatacgttgccggttattatgatgtcccggtattaatggtagccggggatgaccgggcggcgaaggaagcggaagagcttatcccgaacgtgacgacagccgcagtcaaacaaaccatttcaagatccgcagtgaagtgcttgtcccctgcgaaagccggacggctgttgacagaaaaaactgcgtttgccctgcaaaacaaggacaaagtcaagccgctcacaccgcctgacaggccagttctgagcattgaattcgccaattatggccaagcagaatgggcgaatctgatgccgggaacggaaatcaagacgggaactacaaccgttcaatttcaggcgaaggacatgcttgaagcctatcaggcgatgcttgtcatgactgagcttgcgatgcggacatcattctgctaaaggggtgttttaggctttggcgcgatacatgataaagcgtttttgggcaatggcagctacgattttggtgattaccaccctgacttttgttctcatgaaggtcattcccggatctccttttaacgaggagagaggcacaaatgaagccgttcaaaaaaatctcgaagcctactatcacttagacgatcctctcattttccaatacattttctacttaaaatccatcattacattcgatttcggaccttcaattaaaaaaccgtcggacagcgtaaatgatatgctggaacgcggatttcccgtttcctttgagcttgggatgacagcgattgtcattgctgtgatttctgggctggtgctgggcgtaatcgctgcactccgccgcaatggctttttggactacgccgcgatgagtcttgcagtactcggcatctccatcccgaattttattctggcaacattgctcattcagcaatttgctgtcaatctcaaactatttcctgctgcgacatggacgagcccgattcatatggtgcttccgaccgcagcgcttgctgtagggccaatggcgatcattgccaggctgacacggtcgagcatggtcgaagttctgacacaggattatatccgcacagcaaaagcaaaagggctttctccattcaaaattatcgtaaaacacgcactcagaaatgcactcatgcccgtcattaccgtcctgggcacactcgtcgccagcatcttaacaggaagctttgtcattgaaaaaatctttgccattccgggaatgggaaaatattttgttgaaagcattaatcagcgggactatcccgtgattatgggaacgaccgttttttacagcgtcattctgattatcatgctgtttttggtcgatttggcctacggtctcttagacccgcgcattaaactgcataagaaagggtgaagcgtgtgaatctccctgtacaaacggatgaacgccagccagaacagcacaatcaggtgcctgatgagtggtttgtcttgaatcaggaaaaaaatcgggaagccgattcggtcaagcggacgagtttgtcatacacgcaggatgcctggaggaggctgaaaaaaaataaattagcgatggccggactctttattcttttatttctttttgtcatggcagttatcgggccctttttatcgccccatagtgtcgtacgccaatcgctgacagaacaaaatcttccgccctcagccgatcattggttcggcaccgatgaactcggccgggatgtgtttacccgaacatggtatggcgcgaggatctcgttgtttgtcggcgtgatggcagcactgattgattttttgatcggtgtcatttacggaggcgttgccggctataaaggcggcagggttgacagcattatgatgcggattatcgaagtactgtacggcctgccgtacctgcttgttgtcattttgctgatggtgctcatgggaccgggactgggcacgattattgtggcgctgactgtgaccgggtgggtcggcatggcgagaattgtaagaggccaggtgcttcagattaaaaattatgaatatgtactcgcctcgaaaacctttggcgcgaaaacctttcgcatcatccgaaagaatttgctgccgaatactatgggggcgatcatcgtacaaatgacattaaccgtacctgccgccatattcgcagaatcatttttaagctttctcggcctcggcatacaggctccgtttgcaagttggggcgtgatggcgaatgacggcctgcccacgattttatctgggcattggtggcgcctgttttttccggcctttttcatatctctgacgatgtacgcgtttaatgtgctgggggacggattgcaggatgcgcttgaccctaagctgaggaggtagctgtatggaaaaagttctgtcagtccaaaatctgcacgtgtcttttacgacttacggcgggacggttcaggcggtcagaggggtgagctttgatttgtataaaggagaaacctttgcgatcgtcggcgaatccggctgcggcaaaagcgttacctcccaaagcatcatgggcctgcttccgccttattcggcgaaggtgacagacggcagcattctatttaaaaacaaagacctttgccgtctctctgacaaagaaatgagaggtataaggggagccgacatttctatgatttttcaagacccgatgacggcgttaaaccctacgctgactgtcggcgaccagctgggggaagcgctattgcgccacaaaaaaatgagcaaaaaagcggcacggaaagaggtgctttccatgctgtcattggttggtattccagatcccgaagagcgcctaaagcaatatccccaccaattcagcggcggcatgagacagcggattgtcattgcgatggcgctgatttgcgagcctgacatcttaattgcggatgaaccgaccaccgccctggatgtaaccattcaggcacagattttagagctgtttaaagagattcagagaaaaacgaatgtgtctgtcatcctgattacacatgatttaggggtcgttgcccaggtagctgacagagtcgcagtcatgtatgccgggaaaatggcggaaatcggcacgagaaaagatattttttatcagccgcagcacccttatacaaaaggactgctggcttctgtcccgcggctggatttagatggagcggagctgatcccgatcgacggaacgccgccggatttattttcgcctccgccgggctgcccgtttgccgcccgctgtccgaacaggatggttgtgtgtgacagggtgtacccgggccagacgatcagatctgactcgcacaccgtcaactgctggctgcaggatcaacgagcagagcatgcggtgctgtcaggagatgcgaaggattgaacatgaaaagggggaagaggatgaaacgagtgaaaaagctatggggcatgggtcttgcattaggactttcgtttgcgctgatggggtgcacagcaaatgaacaggccggaaaagaaggcagtcatgacaaggcaaaaaccagcggagaaaaggtgctgtatgtaaataatgaaaatgaaccgacttcattcgatccgccgatcggctttaataatgtgtcatggcagccgttaaataacatcatggaggggctgacgcgtcttggcaaagatcatgagcccgagccggcaatggcggagaaatggtctgtttcgaaagataataaaacttacacatttacgattcgggaaaatgcgaaatggacaaacggagatcctgtaacagccggagacttcgaatacgcgtggaagcggatgcttgatccgaaaaaaggcgcttcatcggcattcctaggttattttattgaaggcggcgaagcatataacagcgggaaagggaaaaaagacgatgtgaaggtgacggcaaaggatgatcgaacccttgaagttacactggaagcaccgcaaaaatattttctgagcgttgtgtccaatcctgcgtattttccggtaaatgaaaaggtcgataaagacaatccgaagtggtttgctgaggcagatacatttgtcggaaacggcccgtttaagctgacggaatggaagcatgatgacagcatcacaatggagaaaagcgacacgtattgggataaagatacagtgaagcttgataaggtgaaatgggcgatggtcagtgacagaaatacagattaccagatgtttcaatcaggggaacttgataccgcttatgtccctgctgagctgagtgatcagctgcttgatcaggataacgtcaatattgttgaccaggcgggtctctatttctatcgatttaatgtcaacatggagccattccaaaatgaaaacatcagaaaagcctttgcgatggctgtggatcaagaggaaattgtaaagtacgtcacgaaaaataatgaaaaaccggcgcgcgcctttgtatcgcctgggtttacgcagcctgacggcaaagatttccgtgaagcaggcggagacttgatcaagcctaacgaaagcaaagcgaagcagctgctagaaaagggcatgaaggaagaaaactataataagcttcctgcgatcacgcttacttacagcacaaagccggagcataaaaaggttgccgaagctattcagcaaaaattgaaaaatagccttggagtcgatgtaaagctggccaatatggaatggaacgtatttttagaggatcaaaaagcgctgaaattccaattctctcaaagctcatttttgcctgattatgcggaccctatcagttttctggaagcctttcaaacgggtaattcgatgaaccgcacaggctgggccaataaagaatacgatcagctgatcaaacaggcgaaaaatgaagccgatgaaaaaacacggttctctcttatgcatcaagctgaagagctgctcatcaatgaagcgccgatcatcccggtttatttttataatcaggttcacctgcaaaatgaacaagtaaagggaattgtccgtcaccctgtcggctatatcgacttaaaatgggcagataaaaactgatggcggtgattgaggaaatactgcttctttatgcgaaggagcggtattttttctctttcttgcacgtatacgtagggtgcagagcaaatgaaaggagtgttttcgttgaattacaagccgaaagcgttgaacaagggtgatacagtcggagtgatcgcgcccgcaagtccgccggatccaaaaaagcttgacaccgcgcttttatttttagaagagctcggtcttcaggtgaagttgggcaaggcgctgaaaaaccagcacggctatttagcgggacaggatgatgagcggctggcggatctccatgagatgttcagagacgatgaggtaaaagcagtgttgtgcgcatgcgggggttttgggacaggacgtatcgccgcgggcattgatttcagcttgatccgcaaacaccctaaaatcttttggggatacagcgatattacgtttttacatactgccattcatcaaaacacaggtcttgtcactttccatggcccgatgctcagcacggatattggccttgacgacgttcacccgctgacaaaagcgtcatataagcagctcttccaggagacggaattcacctatacagaagagctttctccgctgaccgagcttgttcctggaaaagcggaaggcgagcttgtcgggggaaatctgtctttgctgacgtctacactgggcacgccatttgaaattgatacgagaggaaagcttctgtttattgaagatattgacgaggagccttatcaaatcgaccggatgctgaatcagctgaaaatgggggggaagctgacggacgcggcgggaattctagtttgtgattttcacaattgtgtcccggtgaagcgagagaagtctctctcgcttgagcaggtgctggaagactatattatttctgcgggcaggcctgctctgagaggatttaaaatcggccactgctcgccaagtattgccgttccgatcggtgcgaaagctgctatgaatacagcagaaaaaacagccgtaatagaggcgggcgtttcagaaggggcgctgaagacatgaaaatcattcgaatcgaaacaagccgaatcgccgttccgctgacaaagccgtttaaaaccgcacttcgcactgtgtatacggctgaatcagtcatagtaaggattacttatgacagcggtgcagtcggatggggagaagcacccccgacgttagtgattacaggagacagcatggatagcattgaaagtgccatccaccatgtgttgaagccggcattgcttggaaaaagcctggcgggctatgaggccattctgcacgacatccagcatcttcttacaggaaatatgagcgcgaaggctgctgtagaaatggctctatacgacggctgggcgcagatgtgcgggctgccgctttatcaaatgcttggcggatatcgagatacgctggaaacagattatactgtcagtgtcaactcacctgaagagatggcagctgatgccgagaattatctcaaacaaggctttcaaacgctgaaaataaaggtcggaaaagatgatattgcaacagatatcgcccgtatccaggaaatcagaaaacgtgtcggatcagctgtgaaactgcgtttagacgctaatcaggggtggaggccgaaggaagcggtaactgccattcggaaaatggaggatgcgggcctaggcattgagcttgtcgagcagcctgtccataaagatgatctcgctgggcttaaaaaggtgacagatgcaacagatacgccgattatggctgatgaaagtgtttttacaccgcgccaggcgttcgaagttctgcaaacccggagcgcagacttgatcaatattaaattgatgaaagcgggcggcatcagcggagcagagaaaattaatgccatggcggaggcctgcggggtggagtgtatggtcggcagcatgatcgaaacgaagctgggcattacggccgcggcgcattttgcggcaagcaagagaaacatcacacgctttgattttgacgcgccgctgatgctgaaaacagatgtattcaatggcggcataacatatagcggcagcacgatttcgatgcctggcaaaccgggcctcggaatcatcggggctgcgcttttgaaaggggaaaaagagcaatgatgcacactgtcatatcagcagtggccaacatctggacagcgcctgattcacctcgtccgtctgatcaattcatgcttcaaccgactgtaatgatcagagactggctggagcgcatgacgtatgatgaacggcttggattatgtacagacaatgtaatccaaactcaggttctctttggcgaaaaggtacttgtgacggcggaacagggggaatgggtttctgtgatcgtgcctagccagccatcccgaaaggatccgcgcggatacccgggctggatgaaaaagtaccagctggaaaaaacaaagcccatccatacacaacacgatgtgatgatcagcaaacctgctgcctttttgtacagaagcaatggggaaaaggagatcgaattaagctttttgacagttctgccccttattgcaaaagaaaacggatattttaaggtttcgaccgtttttggggaaaggtttgtgaggcaaagtgatgcagtgcctgtcagccaacagaaagggactgctgaagacatcattcaaacgggtgcgttttttcttggccttccctacctgtggggagggatcagcgggtttgggtttgattgctccggatttatgtacagtatatttaaggcgaatggatacagcatcccccgtgatgcgggagatcaggctaaggcagggaagggtgtcccgcttgatgatatgaaagccggtgatctgctgttttttgcttatgaggaaggaaaaggagcgattcatcacgtcggtctgtatgtaggcggcgggaaaatgcttcattctccaaagacagggaagtcaatcgaaatcctcacattaacagagacaatctatgaaaaagaattatgtgcggtgcgccgctgtttttcagaataaggagggagacaaatgacgccactgcctttgttagaggtcagccagctaaaaatgcattttgacgcagggaaaaagcggacagtcaaagccgtcgacggggtcacctttcagattcgtgaaggagaaacgttcgggctagtcggggaatcagggtgcgggaaatcaaccttggggagagtgctgatgcgcctttatcagccgacagaaggaagcgtgacataccgcggcacaaatcttcatgcactgagtgaaaaagagcagtttgccttcaaccgcaaactgcagatgatttttcaggacccttatgcttcacttaacccgcgcatgaccgttcgagaaattattttggagccgatggagattcacaatctctacaatacccataaagcgcggcttctcgtcgtggacgagctgcttgaggcagttgggcttcaccccgattttggcagccgttatccgcatgaattcagcggcgggcaaaggcaaagaatcgggattgcgagagcactgtcgctgaatcctgaatttatcgtggcggacgaaccgatttctgctcttgatgtctctgttcaagcgcaggtggttaacctgctgaagcggcttcaaaaagagaaagggctaacgtttttattcattgcccatgatctttcgatggtgaagcatatcagtgacaggatcggtgttatgtacttaggacacatgatggaaattacagagagcggcaccttgtatcgtgaaccgctccatccctatacaaaggcgcttttgtcctcgattccgattccggatcccgaattggaggacaagcgtgagcgtattctcttgaaaggggagctgccgagcccagtgaatccgccgagcggctgcgtgtttcgtacccgttgtccggaggcgatgcctgaatgtggagaatctcgtccccagcttcaagaaatcgaacccggccgttttgtcgcttgccatctgtatcgaaatgctgaaacgaaggaaaaagtgagataaataaaaagagtggctcctttttactagagccactccatttgtttatacttgatgtaaaaactttacacaaaccgggtaagggacagaaaccgttgatgggaggagtgtcaatcggccggtttctttgtctctttcaaacaagacaaggttgcctgtttcttcatttgaagcaacgaggaacccttccgttgggtcaaatacaaagtcacgaggccagtttccttctgtcgacactctttctacgaaagccagctctcctgaatattgattcacttcaaatacggcgatactgtcatggccgcggtttgcgacataaacaaaacgtccgtcctgcgtgacatgaattgcgcttccctggctgttatctgtaaaatcatcagggatggcagaaacgacttggatttctctaaattcgccggctgtcgggttgtattcaagcgcaatcacttcattgcttaattctgtcatgacataagcgtatttttctttcggatgaaaagcgatatggcgaggtcctgcaccgggagcgaaggaatggcttccggattcagtcaacacaccgtctttaagcttataggtgtagagcttatctatacctaaatcaaccgctaccacataattgtgttcaggtgtgaaccccgcgtagtgtgtatgcggtttttcttgtctttcgtgcggcccttttcctgtgtgagcggcctctgaaacaggtgattgcaagctgccgtcttcctgaaccggaaaaacgtgtaccttcccgctgtgataattggcagtcaggacgaattgattttgatcatcaatgcttacgtggcatggcgaagggccatcaattaactgatgattcagaaatgtcaattcgccgctgtttttatcgatttgataggcagcaactccgccttggccgtctgctttttcgatggaataaaggatggtgttgtttttattcggcgccacatatgtcgggttgcccagcttagcggccagctttggctcgctgagtgcttttttctcagtatcaagctcaaatgaataaattccttcgcttccgccttttgtatatgttcccacatatcctatgtattttgtcatgcgatttcccccttaaaaatgatgtcacctctatattaacgtatcttgataaaataagctgttcaaaacatgaaaaaggggaagattcttcattcgcctcgaatcagcggcattgtgcagcacctgaaggagccgcctgatttaataatttctgacaggtcaatttcgataatgtgatagcctcttttcgatagctgttgattgacatggcggttgccagggagactgatgatcgtttttttttcgattgaaaggacgttggtgccaagcgtaaattgttcgtcctcgggcacctcaataagatcataacgttttgccagcatatcggctgcaactggctcaatggcctgtggataaattaacgcttcgctttcagatataatgttaaatacgcagtccaaatgcaaaaatttttcatgaagcttcactggaacgatcgtatattcaggaagtgcctcttccagctggccgatagctgaaatgtcggtgcgctggctgattccgacatagacaatgtcatcatcgataatgacgtctccgccttcaatactcgtatcaagcatgcgggtgtaagagataccttggctgtgaaaaaaatcttttataacggcttcttctccttggcgaatcggttcagtcatgcttgacagaaaggctttttctccgatgacaaatcctatgtccctagtaaaaacctgctctggtagtccgtcgcgaacgggcaaaaggacgacctcaacgttgtgtgacctaagtgcctccactaagcggctgtgctggtcgttagcggtttttacatgaatattgtcatcttcaaaatgtttttgtgtttcgtttataacatcttttatggtcatgtgctcaggtttgcataagatcactttctgaagtgtgccgtattccgttcggcataccgttttgtgctgagatttcgggatggatacgtccatttgtttttcctcctaaagtgtgaagaatacatttattattccctcatcatgaaaatcattaaaccattttaaattttagacaaatggaagagaatattgtttaataggagaatataagtgcatttagctaaaagatcagacatcaaaggggagaaaggtatggaaacaccggaaacaagattttgtaaagagtcaaaggttgtgaaaaccagcagggtgttcccgcttgacacgaacaaccataatacgctgtttggcggaaaattaatgagctacatagacgacattgcctctatttcagcggcgcgccattgcagacgtgaaacggtaacagcttcaatggattctgtagattttttaaagccgatcgggcaaaaggattctgtctgcctagagtcatatgtgacatgggtcggcacatcttccatggaagtatttgtgaaagttattaaggagcatttgatgactggcgaacgggaactcgctgccacatcctttttgacatttgtcgcattagattcaaatggcaagccggtgcctgtaccgagggttgtaccggaaacagaagaagaaatcatgctgcataatacagctgtacagcgtgctaatgaacgtaagaaccgcaagaaacacagccaggcgcttgcgaatgcgcttggaactgataagccttggtgaacgttaaacccaaaacataagttgttttgggttttttttttgtacttttcaatggtgattattgcaatggttagtccgtttttgctaggggattctataaaaaagcaacaaatgtcatgttaaattgataattttgtgacaactttattaaagattcattttagatatatcttttattcgtaagatcatgtattttaaagatatattatgaatacatcttttcgaaaggattgtttataaaatgttagataacaaaacaatcgaaattattaaaagcactgtacccgtattgcaacagcatggagaaacaatcactggccgtttttacgatcggatgtttcaagaccatccagagcttttgaacatttttaatcaaacaaaccaaaagaaaaaaacacagcgaactgcactggcaaatgccgttattgcagctgcggcaaacattgaccaattaggaaacatcattccggttgtcaaacaaatcggccacaagcaccgcagtatcggaattaagcctgagcactacccaatcgtcggtaaatatttgctgattgcgattaaagatgtattgggagacgctgcaacccctgacattatgcaggcatgggagaaagcgtacggagtcattgctgacgcgttcatcggaattgaaaaagacatgtatgaacaggcggaagagcaagccggcggctggaaagagtataagccattcgttatcgcaaaaaaagagcgggaaagcaaagaaattacatccttctatttgaaaacggaagacggcaagccgttacctgaattccaagcagggcaatatatcagcatcaaagtgcggattcctgattctgaatatacgcatatccgccagtacagcctgtctgatatgccgggaaaagactattatcgaatttccgtgaaaaaggatggtgtcgtgtcttcctacttacacgatgggctgcaggagggagattcaatagagatcagcgcaccggcaggggactttgttttagatcatgcatcacaaaaagatctcgttttgatcagtgccggagttggcattacaccaatgatcagcatgctgaaaacatctgtttccaaacagcctgaacggcaaattctgttcattcatgcggcgaaaaacagtgaatatcatgcattgcgccatgaagtagaagaagcagcaaaacattctgctgttaaaacagcatttgtgtatcgcgagccgacagaggaagaccgtgcaggtgatctgcattttcatgaaggacagattgatcagcaattcctcaaagaactgattgccaacacagatgcggattactatatttgcggttcaccgtcgtttattacggcaatgcataagcttgtatcagagctcggaacagcgccggagtctatccattacgagctattcggcccgcaattaagtttggcgcagtccgtttgaacacatacatgaaactcttctcctttcagagaagagttttttattgagatataagaaggcagacaagcgccggtttctacatccggacaatcacagacccttgccatttgtgcatacacggttttgctgttcttgcattgttttcagcaattcattgtttacctcaatcgctctaattagttgctccatccttagctccaaaccggccagcctgtcgattgtttgctgctggtagctctcgggttggggagccaaaggcagatcaaagggccaaagggtattcgacttctgatttttcatattgcgtattgcgcctccaatcggtgtcactttctattatgttatgttcaggcgatatgcacgttcgcctagacactgatgcatagagggcctgccacggggtacaataggctcaatatgaccagcggatggaggtaaagatcggtgttatggatggtatgggtatttttactgaagccagttatcgtattttcgattgcatatattttgtttcggcttgccggtaaaaaagctgtgtcacaaatgaacaattttgacctgcttttgaccttcgcaatcggaaccattatcagtgagccgatccttacatccaagctgccgatgtcaatttattatgcgggtgcttttttggtgctttatcttatcatgagcaagctctctttatctaataaatggcgatggctcctagtcgtgagcccgactgtcctaatccgaaacggggatattgatgaacgcggccttcgtaaagaaaggctgactgttaatgagctgcttggaaagctgagggaaaagggctatgccgacccggctgacattgatcttgctatcattgaagaaacgggagaagtaagcgtcatcccgaaagaggaagcgagagcggtgcaggtgcgggatttaaatatggaagctgaacggaattttatcccgattccgctcatactggatggcgaaatccttgatcataatttgaaatatctccaaaaaaaccgatcctggctgtttgagaagcttgaggaaaaagggtacagccccaaactgctgtcttcgattacccttggcacgatgaatgcacgcggtgatatatcccttgatttaaataccgctaatgaaccgcagcatgatccttacttatataaaccgggaaataacaattaagatggctctctcttgtaatgagagcttttttcttttttaaagggaatttttgtttggtgtcaaatgtacctagttaggaggggaactgaacatgaaggacttatccataagaaacgacatggcgccaacggtcagtttgctgtattccgcagtggaagaaaacagtctccgtctggcttccatcgtaagccatatgacacacagtgaactttactataaggggcgctgccaaacaaaaaacagcacggctcagcttttgcaccatatcacaaatgttgatatcagatgggtctggcgtatcaaggaaaatcggatcccggaccatattgaacaggcatacggcccgatgacagatgaaagcggacggctgcctgaaccggtgaatcagccaaacttagatgaactcctgaaaagacatcagcatgtagtagagaagctgaaatcggtatgcttcactttaactgaaaatgctttgaaccagccgctttccttcgaaggtgacaccgcgacgatacgatggggaatttggcatatggcagatcataaccgctatcatcaggcacatattgaagctctcaaaaaagaatggaagcaggatgtggcgaagtatgaacgctaaaacgaagcttgtgactgatcgaattcgtttgcgctgtatggaagatcgggatcaagccactttgtttgggctgctttttaatgatcctgacgtcatgacatattattccggtttaaaagataagaggcaaacccgcgagtgggtcaattggaaccaacgaaatgaaaaagggtacggcgttagtctgtggatcgccgaagataagcggacaggggagtttttggggcaatgcggcatcgttccccagcagatcgaaaatcaaaccgtaatggaaattggatatatgtttgcccgccgccactgggggaacggctatgcgcaagaagcagctcgggcctgtctggacatggctttaacgagcggcagttcggcaaaatgacggctttgattgatccgggtaacaaagcgtccatacgggtagcggagaaaatcggcatgcattacagcaaaacgatcagaaaatggaataaaccgatcgaggtatatgaaagaaaatcttacaattgaaagatagagctcagtttagtatcatgatatcatgtaaagttttctagggttccgcatgtcaattgacatggactggtccgagagaaaacacatacgcgtaaatagaagcgcgtatgcacacggagggaaaaaagcccgggagagtcaatctcatgtgagacgactgtccggggtttttttgttttcggagaatcctaatagatagaaaggaatgactcaaaatgaaatggggattggtcgtgcttgccgctgttttcgaggttgtttgggtgataggcttaaagcacgctgactcagccttaacatggagcggcactgccatcggcatcatattcagcttttaccttctaatgaaggcgactcacagtctgcctgttggtaccgtgtatgccgtctttaccgggctcggcacagcgggaacagtacttagtgaaatcgttgtttttcatgaaccggttggatggccgaagctattgttaattggtgtgctcttaatcggtgtaatcgggttgaagcttgtgacacaggatgagacagaggaaaaaggaggcgaggcataatgctgcactggatcagtttattgtgcgcgggctgtttagaaatggccggcgtggcccttatgaatcaatatgcgaaagaaaaaagcgtgaaatgggtgctgttgatcattgttggttttgccgcttcattttccttgctgtcgtacgcaatggaaaccattccgatgggaacggcttacgcggtctggacaggaattggcaccgccggcggggcgcttatcggcatcctcttttacaaggagcagaaagacgccaaacggatcttctttatcgcgttgattttatgctcagcagttggtttaaaaattctgtcataaattgatttttatcaaatcttcagtataatggataaatagtttagacttacaaagataagagggattattcatgaaatcatatatgactcagcggttggacgaataccgtgacggaaatgaggataaagggcggctcttggtcagctgccccgatcagccgggtatcgtctctgcagtttccgcgtttttatttgaacacggtgccaatattatagaatcaaatcaatatacgacagaccctgaaggcggccggttcttcctgagaatcgaattcaactgcgcaggcattcgtgagaaaaaaacatcacttcaggcggcgtttgcctctgtagcggataaattcgacatgacatggagcttaactttggcaagtgaattgaagcgtgtcgccatttttgtttcaaaggagcttcattgcctgcatgagctgatttgggaatggcaaaccggcaacctgatggcggagatcgctgttgtcatcagtaaccatgagggagcgagagagctggttgagcgcctgaacattccattccactatatgaaagcgaacaaagacatcagagcggaagtcgaaaagaagcagcttgaactgctggagcagtacgatgttgatgtcatcgtgctcgcacgctatatgcagattctaactcctgattttgtttcggctcatccgaatcgcatcatcaatatccaccattcattcctgccagcttttatcggtgcgaatccgtacaaacgggcctacgagcgcggcgtgaaactgatcggtgcgacatctcattatgtgacaaacgatcttgatgaagggccgatcattgaacaggatattgagcgtgtggaccaccgcgataatgcggaagcgctgaaaaacatcggaagaacaattgagcgcagcgtgcttgcccgtgctgtgaaatggcatttggaagaccgtgtcatcgttcatgaaaataaaacaatcgtctttaactagactgcaagaggcccgcgcaatgcgggctatttttgatgacaaaaaaccttgacaagtgtcttttttctttgcataatataaaaaaatcattgagcgttgaagaggattagtaagcagacctttctgtgacagagagcaaaatgaatcgctgaaacattttgccgcatgaaacctgccgaacctgccttggagtcctagggggaaaacctaggcgcataacctggcgttacaggagagcggagcgtgcacaagcgcgttcaatcaaggtggtaccacggaaacccatttcgtccttatgaatcaggatgaaatgggtttttttattgtagaagagccgcggaggagaataaatgaaaaaacaaagaatagtagtgaaaataggaagcagttcgctcacgaatagcaaaggaagcattgatgaggcaaaaatcagagagcatgttcaggcgatttccgtgttaaaaaaagcggggcatgaaatgattctgattacctcgggtgccgtagcggcggggttttccagcctcggttatccgtcccgtcccgttaccatcaaaggaaaacaggcggcggccgcggtcggacaaacactgttaatgcagcaatatatgaatcaatttaaacaatactcattaactccgggacaaatccttttaacgagaaatgatttttcgaaaagagaacggtaccgaaacgcgtatgctacgataatggaattattggaacgcggcgtcattccgattatcaacgagaacgattctacatctgttgaagaattgacattcggagataatgatatgctttctgcgttagtcagcggattgattcacgcggaccagctcatgattctcaccgacattaacggactgtatgatgccaatccaaatgaaaatcctgaggcgaaacgatttgattatttgccggagatcacgcctgaattgcttggatatgcaggttcagctggatcaaaggtcggcaccggcggaatgaaatcaaagctgttagccgcacaaaccgcgttgtctctgggagtgaaagtattcattggaactggcagcggagagcaaaaacttgcggacattttggacggcaggggagacggcacttatatcggagacaaagaactatcttcggttaacaacacaaggcagtggattcagttccactcgccgatatcgggagaaattatcattgatgcgggtgccgaggaggcgatgatccataatggaagcagccttttgcccgctggcgttgtgggcgtgaacggaagctttccgaaaggggcggtcgtggaagtcaggggaccgggcggcgtgatcggcaaaggccaaacccattactcctctgaggagattatggaggccaagggcaaacgcagtgacgaacttgattttgagaaaacgtttgaggttattcataggaatgactgggtcaatgtaaaagactaggaggcggaaaaatgagtgaagtttctgtaaaagcgaagctggcgaaagaagcagcagccgaaatgatcatgaaaacaacaaccgagaaggatgaggcgctcagcctcattgcaaacggactccgtaaagaactggattttctcttggcggagaatgcaaaagacattgagaatggaaaagagaatggtttaacaccggacatcattgaccgtctcacattggatgagaaacggatacgcgatatcgcggacgcggtggagctcttaatcgacttagcggacccaatcggcgactctcttgaaacgattgaaaaagaaaacggcctgtttattgaaaaaatccgtgtgccgctcggtgtcgtaggaatgatttatgaggcgaggccaaacgtcacagttgatgcggctaccctttgcctgaagacagggaacgcggttgtgctgcggggaagctcctcagccatccacagcaacaaagcgctcgtcagtgtcattcacagagcacttgagcaatcagcgcttccgattcacgctgtgcagctgattgaggatacgagcagagagacagcaaaagagctctttacgttaaatgatggcttagacgtattgattccgcgcggaggcaagaaactgattgatctcgttgtgagagaatcaacagttcctgtattagaaacgggagcaggaaactgccacatattcattgacgaaacagccaaaccgcaaatggcagaaaaggttgtcgtaaatgccaaaacgcagcggccttccgtatgcaacgcgattgaatcattgctgattcacaaggcatgggcaagacagcacgggaaagaattgctggcccagctggaaaacgcgggagttgaaattcgcggtgatgaacttgtatgtgaacttcacccttcaagtaaacaagcatcaaaagaagattgggaaaccgaatttttagcgcctgtcctcagcgtaaagacggttgaaaacgtccaagaagctgtgaagcatatccaacaatacggcaccaatcattcagaagcgattttaactgaaaatgacaaaaacgcggcatattttcaaacggctgtcgatgctgccgcggtctatcataacgcgtcaacccgctttaccgacggctttgaattcggctacggagccgaaatcggcatcagcacgcaaaagcttcatgcaagaggaccgatggggcttcctgcactgacttctacaaaatacatcattaaaggaactgggcaaatccgtgaatagcggggcaatgttcaatgaaaaagcttatctcattacgagataagcttttttatacgcgaaaaattgacatttcaaatttaattgtgtacaatttaattgtataaaatatatcgggggaatgaaaaatgagtcagccattatttacagcaactgtttcagcggtaggaggaagagaaggaaaggtcatttcatcagaccgcgttcttgagcttgatgtcgcaatgccggggacaccgagagccaagaaattagaaaaagcgacaaatccagagcagctgtttgcagcaggttatgcagcttgctttgacagcgccctgcagcttgtcgcaagaacagaacgggtaaaagtagagacagaggttacagcgaatgtaagtctgttaaaggatgaagcggaccagggctacaagcttggtgtgacgctgcaagtaaaaggagaaggagtcagtgcatcagaattggaggcgcttgtgaaaaaagcgcacggcgtctgcccgtactcaaaagcaacctccggaaatattgatgtgacacttgaagttgctgaataaataaaaagaggatgcctgtacaaggcatcctcaatttttttgatgaagtgtttccagcaatgtatatagagcggattttaactgtttgagatcctccccagactgctttgagagccccagaattgtctctggaatgtcaaccgctttttcttttaataacgctccgtcctctgtcaggctgatcaacacggaccgctcatcctcttcagatctttttctcgtaatcaaaccctgttgttccattcgtttaagcatcggagtgagcgtccctgaatctaaatacagctgttcgcccatttttttgacagtaagcgtttcatgttcccataacaaaagcaaagccaaatattgagggtatgttatattcagcttatcaagcagcggcttgtattgctttgtcatttcccgcgaacttgcatatagcaaaaaacatagctgattctccaatttcatatgatcaaatttattttccattttgttcaccaactcttttttgtcattcgattctattgtatctgaaaaacctcacttttcctattctcggcaaacatagcatgtttaaaaagattagaaagggaaatataacaactagatacaaataaggaggttgggaaatatggcactatttacagcaaaagtaaccgcgcgaggcggacgagcaggacatattacatcagatgacggtgttcttgattttgatattgtcatgccaaatgccaaaaaagaaggacgaaccggcacaaatccggaacagctctttgcggcagggtatgctgcatgcttcggcggcgcgctcgaacacgtagccaaagagcagaatatcgaaattgattcggagattgaagggcaggtcagcctcatgaaggatgagagcgacggcgggtttaaaatcggtgtcacacttgttgtgaacacgaaagatttagatcgggaaaaggcacaagagcttgtcaacgccgctcatgaattctgtccttactcaaaggcaaccagaggaaatgttgatgtaaaactcgaattaaaataatgaccggcatcctgagtgttctcaggatgtttttttggtgtcggagcatgcggggcgggcacagatttatgataaaacttcagagaagcgtttgaagcatgcctttaaaccaaaagttacagatgaagcgggtggctggcacggtgtctgccgtgctgaattgcgcgtatatgctgttttgtatttgcacagggcatagcggctacttggagaaataacaaggaccaggccgcgcatgcctgatccttttaatattctttcttattggcgaagttccgccatgcttgaaacggggataaatgctctgttagtgtcacttgataaaaggggatcgttctttcttcagcaggtttatcaatttctttataaatgaatgaatcatcaaacccggcttcggcagcgtctgtgtgctcagctgcatagaaaacggctttaggccgggcccagtagatggcgcccaagcacattgggcatggttcacagctcgtatacaaaatgcagtcatcaagctggtaggctcctagcaccttacaggctttccgaatagctgtgacttccgcgtgggcagtcggatcattgcttgttgtgacgttgttctgtccttctgcaataatggctccgtctttcacgataacggctccaaaaggcccgccaactcctgcattcaccccatcacgagcaagatcgacagcccgctttaagaactttttatgattcatcccaaaccctcctgtcagttgagtgttataagtatagccgaaaaaggggcaaagaacattctcaaaaaagtgcaaaataaacaaagtatttgggggatttgctaagataagaggagaaaagaggaggggtaatgatgctgcatttatatattgccaggcacggacagacccaatggaacgtggaaaaacggatgcagggctggctggattctgatttaacagaacttggactgtataacgcccgcgctcttggggagcgtctgaaggatattgaattgaatcaggtatacatcagcccgagcaagcggacagaagagacagcaaaaaccgtactgggatcgcggaggctcccgctggttaaagatcatatgttcagagaaatgtcactgggctcatgggaagggaaaaaacaagaagatattgaaagggacgaaccagatctttttcatgcttattttcattatcccgaagcttatcgccagcagggatgtgaaacgttttttgactttgaaaaccgggtaaggctggctctccaaactattttgagccttgtggaatttgatgaaaatggaacagccaaaatattaatagaaggggacgggaagcatcggaaaccgatttccgctttctaatagaaaaaaccatctgccaaagacagatggtttctattttatacaagctgtgtctgctgtgctctcgcctgttttgcggcttcaaccatgtttttcaatgcggcaaccgtttcttcctgctgtcttgttttcaatccgcagtccggatttacccagaagcggtcagtcggacagacggcaagcgcctcaacaataatgttgtacatttcttcagttgacggcacacgagggctgtgaatgtcatatacaccaaggccaagccctttcaaatacgggtggtcttttaagtaatctaaaaatcctccgtggcttctgctatgttcgattgtaatcacatcggcatcaagatcattgattgtatcaacgatatcttcgaagttgctgtagcacatatgtgtatgaatttgtgtctcgtttttcacggaagaagtggttaatctgaaagcttctgccgcccaagtcaaatactcatcccaatcgcgggttttcaatggaaggccttcacgcagcgctggttcatcgacttgaatgatttgaatgcctgcgtcttcaagcgctttaacttctttgcgaagggcaagcccgatttggaaggcgatttctttcctcgagatgtcgtttcgagggaaagaccagtttaagattgtaaccgggcccgtcagcattccttttacatgcttggaagtcaatgactgtgcgtagactgtgtctttcactgtcatcggttcaataaattcaacatctccgtaaatgactggcgggcggacacagcgtgagccgtatgattgaacccaggcatatttagtgaaggcgaaaccggccagcttttcaccgaagtattcgaccatgtctgtccgttcaaattcgccgtgaacaaggacatcaagctccaattcttcctgaatatcaatccatctttttgtttccgcattgataaagttttgatactgttcatcggaccactcagctttccgccatttttggcgtgcgctccgcacttcagcagactgcgggaagctgccgatcgttgtcgtcggcaaaagcggaaggccgagagattcattttgcagggctaaacgttcttcaaacggaatcggacgcttgaagtctttatcagttaattgctcaagctctttcttttgttcagaattggcgcctgttgcaaactgtttaagcgcctggatatcagccttagcctgctgaatctcttcgctgatcgccgcttttcctgatactaagccttctttcaaagctgttagctcggccagcttttcttttgcgtaggataatccgttcaataggtctttttccaaatgctcatcagggtgtttcgctactggaacatgcagcaggctgctggaaggctgaatccacagttcatcaacttttgcaatgctgagaatatcaagaacagcatcgagacgctcttcaaggtccgctttccaaatgttgcgtccgtcgataacgccggctgccagcactttgtctgtcgggaagccatgtgttttaagctgttccaggtttctgcctttgtcgtgaacgaaatcaaggccaattccctgaaccgggtaagagatcagctcttcataagcatcaacagaatcaaaatacgtctgcaaaagcacattcaaggatgaaagctcacttgtaatgctttcaaataattcttttgcaccgcggacatcttcactagaggcggtaacgagcgccggctcatcgatttgaacccattttacgccttcttcttcaagctctttcaaaagctgtacatataatggcacaaggcgtttttggatcgcttttgcttcagacggttcatagcctttagcaagcgtaacgaacgtataagggccgacaatcacaggctttgtttccacaccgtattcctgtttgatccggcgataatcttcgagttgtttgtttcttgtcagacggaactcaatgctctcgtcatattccggaacgatgtaatggtaatttgtattaaaccattttgtcatttcactagatacggcgtctttgattccgcgggcgatagcgaagtatgtatcggtagcgtcagtcaaatgtctgaaacgtttcgggatccagttgaagctgactgctgtgtcgagtacatggtcatactgtgtgaaatcagaaacaggcacaacatcaatctgctggtcaatttgtgtttttactgcggataaaaatagttcgtcgctttgcttcaaaaacgtatctttatcagtactgcctttccaatacgcttcaagtgcttttttccattcccggttcagtccgattctcggaaatcctaaattcgatgttttgatggttgtcattgtttctcctcctttatatgtaaaacactctctttcacccgcggatacaggctgctaagaggttttctcacaacaaaaagcctctttcccatgagagaaagaggcttttctacgtaaaacactgcctctctcatctctcagacacaatctgatggaattagcaccgtgccttatgagacatcagtctcggcgcgaaaagcagtgcgccccatttcacaatggtattacggtcggttgctgttggggtcaaaaggccaatccctcgcccaactctcgataagagaaaatgttattaattttttgaaaagttgaatcatttgttggtaatcttaacagtaattcaaattcattgtcaacatagaatttgaaatttttatttatatgatgtggtgtatattatataagaaaaataatcttatagggttaacaaatgtgattgctctgctttttctgcgagttcatcaggagctgttaaatacaggaatccattgcctgccagcgtttttgcaatatcaagaggaagtgtcctgcggattagctgtgcgaaaacctcagattcagaaagctttctttgaaatgattcttcttcatagcttttgattaaagcaagcgcaccgctgacatgaggggcagccattgaagtgccggtcagcttaccgtacttcttgttgggaagggtggataagatattttctcctggtgccacaaggtcaatctctttatttgcgttagaaaattctgataattctcgtgctactgaaacagatccaactgcaatgacttcgttataagctgcggggtaggaaagctcttctgtgcgttcgtcgccgtcaccctcatttcccgctgcacaaacgacaagcactccgtttttgactgcgtttttcactgcttcttccagctctggcacatcgcttggccctccaagggacattgagatgatgtcgactttctgttccaccgcgtagttgatgccgttaattatccattcgtattgtccgctgccgttctcgccgccaagaaccttcacaatcaataggcttgcctcaggcgcgactccggcaatgcctccgtttgaatcattagctgcaattgttccggcgacgtgtgtgccgtgtccgttgtagtcggaaattgcatcttccttgccgccgtcgtcatccgtgaagttctttccgccgatgatttgattttttaaatcagggtggcttgtgtcgcagcccgtgtctaatacagcaactttaatatttttgccttttaccccttttgcccacatttctggcgccttaatcactttaatgccctcaggaagctcgtttacatccatgatctgctcattcgtcacatacgggatcaagcggatttcaccattcataaaaaagccctccttttttatgctttcaagtggattcaagggtgttgcctcatattatatgaaaaaaacaagcgctcggacagagccatttgaagcattttgaaaaaataggatacacaccaaagaattagtaattttcaaaatattggatggcttcggcgtgtatgactgggattcaactgtaagtcaagttataatagtgttggggaaaggagcagtgtcatgaaactgaatgaaaaattatatgcatttttttcagagcatgtggaacaaatggccgaggaatggattgaaacgatggaggaaagtgatccgaattcgctttacgccctacataatgcaacagtaacggaagaattgaaagagcaggacagagaattttaccggcatctgaattacatgtatgttttaccggaaaaacaatttctcgaagagtttcaagagtgggtcattgagctgaccaacgatcaaaaacatctcgacacaccggttcagtatgtcattcgggagtttatgagaaacaggagattatatacgaagtattttgagaagttcgcagaagaaaatgagtcagcgtttgaaccgggagagaagcaaaaatgggcagatttgattgtaaaagtatttgatttcaccatttatacattcgttgatcacgctgaaatgaatgccaagcagcaattaaacgcccaaagagaaatgatattggaactaagctcacctgtcattaccctgagcaaatcaacagctctgctgccgcttgtcggtgacattgataccgaacgggcgaagtttattctggaaaacacgcttcaagcttgtgcgaaaagacgtgtggagcatctgttaatcgatctgtcaggtgttgttgtggtggatacgatggtggcgcaccagatctttaaattgattgaggcgcttaatctgatcggtgtccggtcaaccctgtcaggaatcaggcctgaaattgcgcaaactgctgtacagctggggattgacttttcgaatattaccattaaaaccaaccttgcccaagcattaaactatcatcaataaaaaaatccgctatctgtgatagcggattttttatgatgcgaaacataaagatacgagaaaggatcccgcgaataataagaggacgaggcaaaagaacacccagtcgcgccggttcacgctcaatttcctataatatgtccggtttctgcttcctgtaaaacctttcgattccatcgcaagcgctgtccgttccgcttttctgatggcgcttgccaatagcggtatggtatatcgttttaacgcactgattttcttaatgatgccgctctccgccgctcctcctctgattttatgagcctgctgaatcagctggatctcatcctttaacagcggaagaaagcgaaagcctgcaatgacaccgtacgcgagctttggtgagagcctgcactgctggacaaggctcagcataaataaaatcggatcggttgtaaaaacaaacatcatcgataaggcggaaaagcataaaatacgaaacccaagggagatgccgacagacacattatcgctgttaattgagatagggcctgcttgaaacaaaaaattattcggtgttgtcggcacctttccaaaaactgcggctgtccacacgcacccgaatgctaaaatcaaaaacggaatcgtaaacaacaaccattttttcaatgggattccggccgccagtagaacgcccgcaacgatgatgatataaaaacatgccggagtgtaagggttgtaaataaacgacagcatgacgacacaacaaaaaaccgccgccgctttcacagtcggattaatgagatgtaacggctgcttcatcacgcacctcctcttgatatgccatccattcatatagaaggggaagggtgagctttgctttttggacaagccctgtttcttgagaaaacaactgcgctggagatccgtcaaaggccaggcctgtatcgtgaagcacaagcacgctgtcagcatacgaagagactagctccatatcgtgtgtaatcataaggacagcggttccctctgtcttgatacgctgaatcatttccatgcattcagtcaccgtgcgggcatcctggccaaaggttggttcgtctaataataaaacctttacgttatgcatgagcatagtagcaacgctcagtcgccgtttttgcccttggctgatcgcaaacggatgatgatcagccaaatgcgcaagaccaaaacgctgcagcaggtgttgcgcttttttctcagtttcagcatttgctttctggccgaacagaagctcgtcatataccgtatcggtgacgaattgatgctcagggttttgaaaaacaaatcccatccgtttacgcaattctttttctttatatttctgcagcggctgatcatagagaaggattttgccgctttgcggtttcatgagacgggccagaactgataggagcgtcgattttccagttccgttcggaccgacaagcgccgttaaagagccttcgcgcaacgaaaagctgatgtctttgaaaatcgcctgctgtcctctcgcgaacgaaaggctgctgacttcaagcacactctccccaggaggggctttcttctttttggcatgcccggcaggaataggctctttgaacagcatctcttttgataaagtaaacggcatactcagcttttcctgcagatgacagacctttggaatggcgatgcccaatttctttagtgtttctgcttcatgctgaaatagatttttcgtcaggccatccagcgcttttttgcccgatttgtcgagcacgatcgttctctcaatccaaggcgcccattcatcaagctggtgctcaatgacgaggaggctgaaacctttttcccgctgaagatccttcatcagatgaacgaactcccgcgctgagaaagggtctaaaagagaggtcggctcatctaaaataataagctcaggctccatcgccaaaatacaggcgagagccactttctgcttttgtcctcctgaaagggttgagatcattttttcttttaaatgggtaatgcgtaatttttctaatacggcgttgattttctctgtcatttcttcttttggaatttgcagattttccagcccgaacgctatttcgtcctccaccgtcagcatgcagaactgctgatcaggatcctgaaaaacgaccccggcatgctgagcaatcgtttcggaggtttcagcatctgtgaccggctgttgaaatagaaagacatgtccggactgaatgccgtcgcaagcctccggatatagaccgtttaaacaaagggcgagcgagcttttaccgcatccgctcggtcctaataataatacacattctcctttttgaagctcaaacgaaatgtcttgaaaaaccggtttctcgtcttcttcataagagaagctgagctgctcaaccgtcagaagctcatcaaaggcttgcatgttctgacgcccgcttccgtttctttttcagttcctttccgagtgccattccgtttaacacacctgtataagcgagagagtcgctgacagcttttccgagaagccccgccaaaagcgcgccggaaatgaggcggatcacaagcataatgagcagataacctggtgaataggctgcatagccagaaacaaagagatcatagataaagctggctactgaagaccccataccggccagcataaggacagggagagagtatgctttccagcgtgttgcaagaaatacagcctcagccccgagcccttgaacaatgccaatgacgatgaccatcgggccagacggatttcccagcaggcactcaacgagagcggcaatgatttcagaaacgagcgcagcacccggttttcgaatcatgtacgcggcgatcacagaaacgataaaccaaatgccgtaaatcggttcataggcgattggcccaaacatacctgcaagtacgtttccgaaatgtgtaaataataaataaacaacggcaaatacgatactgataacggacatgatgacaatttcttttactttccagcttttcatgttatccctgctttctgttttttcttgatggactgttagccgaaagattcacagtcatggtgatgtggtttgtttgctgctcagccatgcggaaaacggcttccaatgtgctgaatacgtcatgcgcatccccgtcaagctcgctcgcgtaatggacaccctgtacgaaagtgccttgggcttttgcaatgtcgacagccttcataatcaatcccatataatccggctcgttcattggataaagggcaaattggcacggcgcttccgccttcaagcctcggacagcatcttcattgacacgcttatcacctttggaaagatatgtatccccctgtgtgtcacccgggcatccaatggaaaacgtgccgttcatgacgatgtgtttttcgctgtttgctgcatgaaggtaaatggcttttgcagcatcgaatacatgatcaatcgatccgcgtaacaccgtgctgatatggtcggttttcgtccataccttggatgtatctgtttttttcaacgcagacttgatcacactgataaaatcatccgtcatcggatataaagagaagcgaaaaccggcgattctgcttgtaccgcaaatatgctccattttctccgacctcctgtttttttggtaaaataaaaaactgcatatcctaagggaatatgcagtcatagatcgattaagcgcacaaaaaaatacaccattcggtcaacctgcacttccccacgctggtattatccagatcgggtcataagggatcaaagcgcgtttcttccgcgctttatctcagccaaaacagcacccctagtgctttccgtatacaattttttattttgacatcataatagatgataagaatcattttgtaaacaacgaaatcatttttttcatatagggacgggagaggatgatcaaatttggaaaaaggacacatattaattgtggaagatgaagaaaaaatcgccagggttcttcagcttgaattggaatatgaaggatacagtgtcaccatcaaacacaatggcacagaaggtctggatgcggcagcgaaaggcgggcattccttggtacttcttgatgtcatgctgccggggcttagcggactggaagtgctgcgccgcttgagaaaaacggattcgcagacaccggtcatattattaacggcgcgagacagtattcctgataaggtaacaggtctggacatcggtgcaaatgactatgtcaccaagccgtttgaaatcgaggaattgcttgcgagaatcagggcggcgctgcgactaaatggaacaaaaacggaagatatcggcacctttcttacatatgacgatttacgggtgaacgaaaaaacccgtgaagtgagacgcggagacaaagaggtggaattaacgccgcgggaatttgatttactcgtctatatgctaaagcatccgcagcaagtgctaacacgggagcaaattctaagctcggtatggggatttgattatatcggtgatacaaatgtcgtggacgtctacataagatacatcagaaaaaaactggactatccttacgaaaaacagctgatccatacgattcgcggggtcggctatgccattaaggggtaaacgatgaagctgaagacaaagattcatctatacacatcaatatcactgttgattttattaattttggttcataccgcagtctatctcattttttcgtccgcgctgacatcaaaggatgcggcccggcttgctgatgagacggataacatggccgaagcgctgcgtgcggctgaaacagaaggagtggctttgcaggatatgctgcaggcctatcttccggcaaatggcatggtgcgtgtagtgaatggtgatcaaaaagccgttatgacgatcacaaaagaaaaagcctataaagattttcctctctcttttcatagcggagaaaaggcagatgtgaggaaacatgacggcaagctgtttgccgaggctgctgttccggtgatttggaccgatggacaagtggtgtctcttcagctggttgaaaggcttgagaacacagaagagagtctgtttctgttgaaaatcatcttaatcgctgcaagtgctgctgtctgcattgcttctttttttgcaggcagcttgctactagcccgccgaatcatcaatccgatcagacgattaatgatcacaatgaaagacatacagcgagacaaagaatttaaaacgatttctttagaaggacagtccaacgatgaattgtatcaaatggggctgacatttaatgaaatggcaatgatgctgaaggagcactatgataaacagcagcaatttgttcaagatgcttcacacgaattgaaaacgccgctcaccattatagaaagctacagcagcctgatgaagcggtggggggcaaaaaagccggaggtgcttgaggagtcgatagaagccattcactcagaagcggtgcatatgaaaaaactgaccaatcagcttttggcgttggccaaaagccatcaaggactcgaggttgatctgaaaacaatcgatctgattaaagcggcgcgcgcggttatgcaaacgctccagtccgtttatcagcgtgacatattgcttgaaacagataaagagagcctgcttgtaaaggctgatgaagaacgcatcaagcagctgttgaccattttgcttgataatgcaataaagtatagtgaaaagcctattgagatgtcagctggaacgaggaatggacggccatttttatcagtgagggatgaaggcatcggaatacctgaggagcatatcccgcatttgttcgaacggttctaccgggcagatgaagcacgaaacagaaaaacaggcggaacgggtttaggcctttccattgccaagcaaatcgccgatgagcatggcattgagctgtctgtcaaaagcaagccgggacaaggaacagctgtcaccatgcaattcagcgaacagaatgggggaggccgatgactaaaacaataaaaacagtatcttttgccgcagcagccattttagttgtcatcatctgtacgtttctcatcattcggcaaacccatgagaacgtattgtcaaaggagactgtcgtaaaaaaaatcgaatcctcttatgaaggcaaggtcacgaaagcaacacaatcaaaggataaaaaaacatatgatataacgcttgaaaatcaaaagggaacttactttgtaaaagcagacgcaatatcggctgacattctttcaatgaatagagtaaaagcagtgaatccatctgccatgacagaaaaagaagccgagcatctcgcgcttgagcgggtgccgggaacggtcaaaaaacaaacacgacaaagtcgagttgccacttataccatacaaaaagaagatgggaaaacatacgaagtgaaggtagacatgcaggcaaaaacagtcttgtctgccgatcaaatcagcagcaaagatcaacaaaaaacgccgattacgaaaaaagaagccaaaacaattgctgagcgagaaacgggaggaacagcggatgacgcagatctcgaagaaagtgagggcactctcatctttgaagtggacgttgatcttcctgataataaggaagcgacagtgaaaatcaatgcctacacaggaaaggtagctaacattgtgtatgaagactgacggtttctcatcaaattctcatcttgctctcgttttcctttcatgttgagtgtgtaaactgtactcatacaaaacaaaggaggactcacaaatgctcaagaaaaaatggatggtcggtcttttagcagggtgcctagcggccggaggattcagctacaacgcgtttgccaaagaaaacaatgaaaacagacaggcttcttctaagacggatgcactcactgaacaagaagcagaagcaattgctaaaacagttgttgacggcacagtagaagacattgacagagacctttacaacggcaaagaagtctatgaagtggagattgaaaaagaaggtgaagactacgacgtttatgtagatattcgtacaaaacaagcgcttaatgacccgctaaaggagaaagcagaacaagtcgccataaccaaagaagaagctgaagaaattgctttaaagcaaacaagcggaaccgtaacagaaagtaagcttgacgaagatgacggtgcttacatctatgaaatggaaatccaaacgaagcaaggaactgagacagaatttgaaatttccgcaaaagatggacgcattatcaaacaggagatagatgactaatcaaaacccccgctgcagcgggggtttttcatgataagaaaccttcttttggacaatctaagtagaaaaggaggcgaaacgcatggaaaagaaagaggagcaatacatcaatcaggctgaatatgtccctcatccgacgaaggaaggagagtacgccttatttcttcatgaaacgtatcatttgctttctgaagatgacgagacacaaacaacagaataagggcttaggcccttgttttgttccgtaattgtgatgtaagcgcatttattacttttttgagttgacacagcttgtttttttctgtaatctcagtgtgtcaattcaattaggaacttcgttaggtgaggctcctgtatggagatacgctgctgcccaaaaatgtccaaagacgccaatgggtcaacagaaatcatcgacataaggtgatttttaatgcagctggatgcttgtcctatgccatacagtgctaaagctctacgattgaaggcgcccgcacgctttttttgccgtgcttctttcaccttcaatcccgaaggctttttttatgcctttaaaacgaaaccaatcaaaggaggtgcggagtatggattctccccattcgagtcaatctgaagaagtacccatatactatgacagcaagacaattgattacacgatgaggagacgaactgccgcaccttctggcgaggccggcacgtctccgtagaggaggtacgagtcccgatggttcaaaacatgacctatgacgaactcattttacgcatcattattttactgcgagacgggaaaatcagggatttcagaagtgttattgatgagcttcagccctatgacatggcatttatttttaaagaaatgccggaaaaacaccgcgcccgctatttatcttatttaactgtagacgatatcactgatatgatcggggagctggaacgcgaatttcagcttgtcgtcttaaataaagtcggaaaaacaaaagcaacactggcgatgaacaaaatggacaacgatgacctcgctcaattgcttgaagaaatggacgaagaactgaaggaacagcttttatccagcatggaagcgtcagagtcaaaagctgtacagctcttaatgaattacccggctgattcagcgggacgcatgatgacaaaccggtatgtgtggattcctcagcattacacggtaaaagacgcggtcgtcaaactgaaaagcttcgctgaaatagctgaatcgatcaactacttatatgttattaatgaaagcaaacagctggttggggttctttcctaccgcgatttgattctgggtgaacctgaagaaaaggtgcaggatttaatgtttacccgcgtcatatcagcagatgctcttcaggaccaggaagaagttgcccgcctgatagaacgttacgattttttggcaataccggttgtagaagaaaacaacgtgcttgtcggcattgtgacggtcgatgatattatcgacgttgttattcgggaagctgatgaggattacgaaaaatttgccgcttccggtaaagacatcacctttgacacaaaagcttacgtggcggcataccggcgcctgccatggctgattttactcttgtttatcggactgatttcaggaagcattatcagctattttgaagacgcgctgaagcaggttgtcgcgcttgcgtttttcatgccgatggtgtcagggatgacaggaaatacgggaacacaatctctcgcggttgttatcagaggtttgtctaaagaagaaatgaacaaaaaaacgattgtgcgcctgatcttccgggagttcagaacaagtatttttatcggagcggtttgttctgtgctgattgcgattgtctccatcatatggcaggggaatgcgcttttgggatttgttgtcgcctcttcactgttcttaaccttaatcatcggcacgatgtcaggaacgattatccctattattttgcacaaactgaaagtagacccggcgattgcttctggaccgctgattacaacgttaaacgatattttatctttattaatctactttggcattgccactgcattcattcactcattataaacgtaaaaagtccgtctcaactgagagccggacttttattatttaacggtttttgtaccgaaagtgagcattaagctgcccctccagcatttttttccgcacttgcggatcgttttttaacatctgttcttttttgcgcatatcctttaaaatctctgccgtctgtacgccgtcttcacgtttattggcgatatccatcagccgctctacatcagcaaaggagtattttcttgtcccccttgaagaacgctgcgggtaaatgagctttcgttcctcataatacctgatctgtcttacggacaatcctgtcaattcactcacaattccgattgaaatcacttttttgtctttataagaatgatcttctgtggtcatttttccacccctggatgtcttttgataatagtatataaaaaacaaagagaaaaaacctaacgcttgtcatattttctaacatcaaatagaagatttttgaaaaaatacggaagaaaaattaacaagaataatgcgtaacacccaagcacgttttatcctttatgtaacgaatcaaacaaggaggaaggataatcatggaggaagaaaaagcggtctcactggcaaaagaaattatagagttggatatcaagcgtgatgaaatgctggagacgtttatgcagcttgccggagaacaggcttttcaattattaagatcggttcaaaacggacaataccgaaaatcttcgtaaacataaattctttacattagattcataccacgttcatttaaaaagagtatcttttgtataggatacctcaaaatgaaggaggacgctatgagtaatttattgaaatccgctttagaaaaagaacgacgccattattctgaaaaactctatcagattggggtttataataaagaggtcatgaacaaaatgacgatttctgagcttcggaaagaatacgcttatttctttcgaagcattacaaatcataaaaattatccttatacaagataatgtataaggatttttttgcttttagaaggaatttctcgaattatagcgaatacgtatagtaagggactgaactcttattatatgtaagggttttcattatttttttataaaaatcctatatacgaggtagatatgatgagattatcgtttaacgaagaagaagttgagcgtgcgatgaatttgtacagagtttttgcaagggctttcaaaagtgtgtccgaacatagtatccgtgatagcaaagagcacggttttaatcccactgaatttgctgtactggaactcctgtacacaagaggcccgcaaaaattacagcaaattgggtcgagacttctgcttgtaagcggaaacgtcacatatgttattgacaaactagaaagaaacgggtttttagtaagggagcaggacccgaaagataaacgctctgtttacgcacatttaactgacaagggaaatgagtatttggataaaatttatccgattcatgcactgcgtattgcgagagcgttttcaggcctttcgcctgatgaacaggaccagctgatcgtcctgctcaagaaagcaggcatacacagccagcatttgctgtttcgttaactattctacactctctgtttcaggagagtgtttttttgtttcataagattctttttaaaacatcttcaatcttcctatcagacatttcgccaaggtatccattgacgtgttttttatactccttcatctgttcgttcgattgaaaaaatgccgcgatatactcttctgctttcttcatgtcccagtttctcatatctgtgacgagtttcctttcatgtagaaggtttaaattcatttcctcctgtcccggcagtgcatgataaataaataccggaagccgtttctgtaagcattcactgatggtcacgcctccgggtttagtcatgatgcctgtcgcctgttcgtacaaacggttcatctctgctttgctgtgaaggtaagaaatcgcctcgatcaaggggtggtgtaaacttttgacataggagtagagcttttcgtttctgccgcataatattttgtataagatctttccgcctggcgacagttcctgcacccattttaaaatcccaccgacccccatactgccccctgtgatgatgatggtatatggcgggtggtgctgcaaggtatctgctgattccattgcaaaatttcggtgaactggaatgccggtcaagtatatgttgttctgatcgatcccctctgatattagctgcttctttacttccgtgctcggaacaaaatggtaatcaatgttcttccgtccccataattgatttacgaaaaaatcagtgtatacattcacaaccgtcagattcggatattcaggctttaatcggttcagcagataagaaggcagcgcatgtgtgcagaaggcgatatcaggctgtttttcttggaggatgtgcctcatttgctgtgtgaacagccattcgtacatgaaatagcgtttgtcatgctggaattctccgcaggcgaggagcctgtaaatgccgctgtacgttttcgggaaatattgaatccattttaaataagccacggaggacaatttttctaaccggctatacgcatgtgaaaagatatcaatcttttcagctgccagcccttgagactctaattcagcctgcaatgcatcagccacatgatgatggccggtggaaatgcttaaaaaaggaaaaatgagaatgtttttcatgacagtcctcctaaaaaaatatggcaactatattttgaggagaacgttcacaaaatataagggtgtttttgatcataaggaaggtgaaaagatgaaaacttgtttcctttccatatggagagtggttgacccgatttatttctttttttcaaggctaagcttgattgacaacgatcaaaaaagcgtttttcgagtcaggctgacgaagtataaaggacatcatgtcgtgcttagcgatggaacgcatattagaaaaaatgatgtgctcgttaaaattcatctgcataacataaagctgatcagggagcttcaaagcattgagagcgcagtcagaaagggaatcattatttatcagaaagtatatcaatcgatgccgcttcttcttgactatatcaacaatcataaaaaaagcgagaaaatcaaaggaatcattgggattacaatgcttgacaaaggtgtggaaaggctcggctttgatgtgatcaccccggtgaatcctttttacagatgctttaaaaaagtgtcccatgtgccgattttatatttgacttcaaagcctgtgagcttgcggcatttaccgaattcatcctatttgtttatctcaaaagaaaagctgcagaaaacctatcaaaaaaaagactgatgcctcggtcagcacagtcttttttgattaaatctgatgaaatgtcacttcagggcggcttccaacacggatatttacgccggtttgtcccaagccctcgctgatataaaatggtttatcgtgatgataatgaaggcctttaatcatgttcattcgcacgagcttgcccattttcaccaaatgatacggttttggccagtgaatttgcccgccgtgaaaatgccctgacagcaggtaatcataatgaacatctttcatatccagaataatatttgggtcatgtgttaagacaagatgatagccattttccagactttgataagagccggtgatattactccgattcgtactgtaatcatcaatgccgataatattgactggccctgcagccgtctcgattcgaacatgttcattttgcagcgtgatacagccgttttcctctaaaactcgcttcaatctctgaaagtcctcttcttttaatacataatcgtggttaccgaacaccgcgtacattccatatgcaggcttcagcttttgcaaggcgttcaagtaacctgccagcttcggaatattacgtttccgatcaagaaaatccccggtaagagcaatgatgtccacaggctgatcttttgttaaatgatacagctcctcaggtgagacagaaatgttttccaagtgaagatctgataaatgaaggatatttaatttttttctggctggaaggccgtctttttggtcgattgaaatggtgttgactttcacatcttttgtattgcggttcgctttatatagaaatggcacaaatacgagtatggccaatgaaagtaagattgtaaacaaaatatatcccctcccttctatcagtatagtaagtgatcaagccctatggatagcgggaattaatgggtagagacaggttgaaaaacggattgtcatatgatgaatgatttggaagggaaaagggataataaattttgacacatgaggcagaacatgccgacggagtcagaataacaaatggatgtgtaagcaatgttacgattgatgagacaacaaaaaaaagaaacatattatctctggatcgcattatttcttcttttattgtatgtatccccgctttttattttaaaggaagatgcccatatccgggtccacgataatttagattccaacatcgcttggtacaaggttctggccgatagcggagaaatcgtcggcaaggttgacgctgccattccgcaaatcattaacgggctgccccgggatgcctttggcaccgagtggagcggaattgtttggctccatgctttcttttcttccatgaccgcctatgcaataagccagacggttacaagagttgtcgctttttttggaatgtatgtgctgctgaagaaacatataatcccggaaccaaaagcggctttcatccgaattggcgtatcgcttgcatttgccttaacaccgttctggccttcgggaatgctgagtacgcttgggtaccctttggcactgtgggcttttttaaatatccgaaaaggggatatctcatggagagagtggctgacgctgggcttgctccctctatactcaagctttgttctaggtttcttctttttcctggcagggatggcgtgtttttggctgtatgatgccattacaaaaagaagatggaatttgatgttcttaggcagtattgcatttatgacgagtatctatcttttcgttgaatatcggcttgtctattcgatgctgtttgagcacgcaccgatgcatcgtatcgaatttatctcatccaggcatgacgtttggcattctcttcggctatccgtaaaaaactttgtctatggccataatcatgtgatgaccgttcataccgttgtcatccttccgatcctgctggtcgtatttgctgctctgctgttcaaacgaaatcggacaaagccagaaaatgtgtatctgtttttatgtgtgcttaattacggattgtcattatggtatgcgttttggttcaacaaaatttgggctgttccaaagcagaaatttgcctttttagcagaatttaattttgcccgttttcattttcttcggccgcttgttatatacgtgagctttgcgcttgctttatatctcatttggcggatggggaaaggatggaaatggcttgtgtacgccgcagtcgctgcacagctgatggtgttggcgccttttaatgaagaatatacgtatggcgttcattacaacgcgccgacattcaaggagttttatgcatcggagcaattcaaagagattaaggaatatatcggacgtccgcaggattcgtacagggtggcgagcatcggactgcatccgtctattgcccaatataacgggttttatacgttagatacgtataacaatctgtatccgctttcatataaatatgaatttaggaaaatcatcgaaaaagagctggaaaaaaattctcggctgaaacaatactttgatgaatggggcagccgctgctacctttttgtcgatgaactcggtaaacgatatgatttcaaaaagaactcgaagaaaacgatcaacaaccttcaattaaatacagatgtatttaaaaaaatgggcggacggtacattttttcttctgttccgatcatgaatgctgaacaaaaccatctcgcgctcgtaaagacgtttgaccataaagattccgcctggcgcatttatttatatgaaacaagataaggaggatatcgattgaaacagtcacagccagtattaaccatcgtcgtcccgtgtttcaatgaagaggaagtgtttcaagaaacaagccgtcagctgacagaggttgtagatgatttaattgaagaaaaattaattgctgaagacagtaaaattctgtttgtcgatgatggcagcaaagaccgcacttgggctttgattgctatggagagcataagaaacaagaaggttaccggcttaaaattagcctgcaatgtcggccaccaaaaagcgcttttagccggactgcataaagcgaagaataggtcagactgcgtcatttcaatcgatgctgatcttcaggacgacatctctgtgatccgggattttatgctgaaatatcatgagggctgcgagatcgtttacggtgtacgccggagcagaaaaaccgatacctttttcaagcgcacgaccgcgttagggttttatcgtctcatgaataagcttgggattaaattaatttataatcatgctgattttcgtttaatgaataaaaggtccctcgaagagcttgagcgttatccggaagcgaatctgtttttaagaggtattgtccccatgatcggctttaaatcggccgaagttttgtatgaccgcaaggaacgctttgccggcaaaacgaaatatccgctgaaaaagatgctatccttcgcttttaacgggattacttcattcagtgtcgcaccaattcgattctttacgcttttagggtttgttttgtttttcctcagcgctgtggcagggattggcgcgtttattcaaaagctgctcggccatacgaatgcaggctgggcgtctcttatcatatccatttggtttttgggcgggctgcaattgatgggaattggaatcatcggagagtatattggaacaattttttctgaagtgaaaagacggccgaaatacgcgatcgatattgatttgtataatgaacagctgagcccgcttcagcgccaggaaaaagagcggttagaaaaaaagtacagttaaacacggaaagagctgacttcattagtcagctctttttcttcaactgatgcaatatagcgctaagcggttcgtcttgcgggttgcggtaaaaatcaaaaaatgggcagccctgcttcttaattcgatcgatgaccgtatcaattgtaaaaagagcgggtgttaaagatgattgcacctcatgccagtagagcggggctgcaacagtcccaagctcatttcctctcgtcgaatagggacagataatcgtttttccttctgcatgctgcaaataatcaagatacaatttgccgtgtctgtttttaatcaagcgttcagtggtaaagagctcgggaaatgcattggtgcagtactctgcgatcagctgcgtaaattggcgtgtttcttcatacgtaaatgcctcgggagacaagggaatataaagctggattcctttgttgccggacagcttcgggtacgatgtgatgccaaaggaatccaacagccgcttcagttcatttgcggcctgcacggccataagaaagtcatctcgcgaaggcgggtctaaatcaatgacaatctcagccggacgcctgcttttaatggtttgaaaaggaacgtgaaactccaaagcaagctggttgcaaagccatagcaatgtagacatatcctcacagacaatatgttcatggcttccatcatagaaggactgaacaaaatccggcgcatagtccggcttgtttttttggaaaaatgattcgctcctagatccatgcggatagcggatgacggtgacagcccggtttttcagaaatgggagcaggtagtcactgacttcaatcatatactgaataaaatcttcttttgtttttttattcttttcaaatatgattttatccaggcttgtgaactggagttttgggtgaaccggtttggagtgtcgtatgacttgcgcatacgtgcattcggtccagtccatttggaattcgaaaccgataaacgatacctctcttaatgtgccatggagaattgttaagtattgaacagctgcacaaatcgaaggttcaagcttaaactcgcctgagggtgtttgatgtccgtgctgttccataatctcgcgtatagcgcttttttcctcatcgcgcattccgtgcgagacagaggcaatcggtgtcattattccgttttttaacaccgataccgtcagaaacccgttgttagggttgaaccctgttatgcaaacataagcttgtttaaagtttttatatttgagccaatcggacgaccgcttcttttcaagccatttgctgtttgttttcttcgctacaattccttctccgtcatattttattaccatctcccagagttgatcaaaatgatcataacagggaatggattgaatggtttcttttgcgtaaggatctggagatgcaggaagctttgctgcggatatgagttcacgcagcgattttttgcggtccaaatacgaaagaagcgttacatcttctccgcttcgctctaacaaatcaaaggcgagaaagcagcacgaccgcgcgtttgccgattcctgaatcttgtctggccttttcaaacgcccccgcacttgaaggtgttcaaaatctgcacgacagggattcaccaaacatacgatttcaccgtcaagtgtcagcggaagctctttttctaggtgctgaaaggcagttttggcgaattgtatgatttcagggaaggtgctgctgagctccacaccatttctgctggttaaggtcacacctgaagaatggatgcggagaatacagcggtacccatcatattttacttcgtaacgccattctgctccgattggcggtgacgaagttaagaccggctgcatggtaaacgccatgcgctatgatgtgccggaggctttttttctagttgttttttgttttttatctccggctcctttcggttcagcggcttgtgcaggtgcggcagccggtgtctcccggttcggccttctggttctgtcgatgctggcttgcagagcgcttaccaggtcaatgacatcttcacgaggtggcgctttatcaggagtgacagccgtttctttattttctagcttgtcgttgactctttgcagcagcgcctgtcggtacgtgtcttcatatttctcaggctcaaacttagcagtcagttcatctattaatgtgatagcagtttgcagttccttatcgtttacattcgattgatcatgtacacctgggacttgagcggcgcttctgacctcatcgggataatggatagactccatgacgatacaattttcataaacgcggagaatcgccagctgctgctttgacctgattgtcatattggcgataccgatctttccggttgagcgcagcgcctcacgcagcagggtataggccttcgtcccattatccccggggccgacaaagtaggagcggttaaaataaatcggatcaatttcctgaagctgaacaaagtcaacaatctcaactgctttctcctcatgctcctgttttaagctttttaaatcttcgtctgtcagcactacatattttccttttacatattcatatcccttcacaatttcatcaggactaagagttttttcgcaatttgtgcaaactttctcgtatttgattggtgcgtgatcctctttatggaggctgcgcagtttaatatctttatcttctgtggccgcatatagcttgatggggatgtttactaatccgaagctgatcgatcccttccacattgtatgcatatcgataaacccctttttttctttagtgtgaagagaaggagtacgattcatgtgtagtaacttatgggtgaaaaaaagccggcgctgttattgcgacggctgttcaataatgaattgttcgaattgttccggaggtattggcctgctgaaaaagaagccctgcaaatggtcgcagcctttttcaaaaagaagctgcttttgagctgcattttccacaccttcggcaatcacctgcaaagacagctgatgccccatggcaataatagctccggtaatttgctctgatttaggatgggtctgaatatcgtcaataaatgatttgtcaatcttcagcctgtgaatcgggaagtccttcaaatagctaagagagctgtgaccagtaccgaaatcgtcaatactgattctgattcctaattctgttagggatgacaaaacctttttggagtgatcgagattgtccattgtcatgctttccgtcacctccacttcaagaagctgcggaggaagctggtatttattaagcgtatccttgatgaggggaatcagatctttagattgaaactgtctggcggaaatattaatggcgacagaaagatcatagcctttgtcatgccaaatccttgcctgcttgcatgcttcatctataatccactttccgatatcaataataagtcccgtttcttctgcaacaccgatgaattctccgggcggacgcagttgcccgtctggtgtcacaaggcgtatcagtgcttctgctcctgtcattttttgttttttcacactgaattgcggctgataatgcaagacaaatctatcgttttcgattgcttctctgagtaccatctcttggttaagcttaacggtttctttgttgccgattgaaaaagaatagtatctgtatttgcttttgtttcgttctttagccgcatacatcgccatatcagcctttttcatcaattcaaggccatccgtcccgtcttttggagatatcgcaatcccgatactgacagatgtgacaagggtgtgatcttgaattttgaaaggttttttgaatttttggataatttttcttgctaaaacatctgcttcgcctgttcctgtattggcgtctgttaatataataataaattcatcaccgccaagacgggcgataaatccgttatcagggactacagatgacaggcgtttagctgcaaactgaagcaattgatcaccgacattatgccctaatgcatcgttaatcactttaaaccggtttaagtcaagaaagaatacaacagtgttataatgcaaggaatgctcgcgattcagcacctttgttagatgagagatggcatgccttctgttaggtaagtctgtaagcgaatcataatgagccattctatggatttctttttctgctttgtactgcttcgtcatgtctttacaaatgacataaatgctgtctagttcctgattgacctcaacaggtataagcgtaatatttaagtgaaactggcctttttcagtgataagatcgctatcgctgttcatcgcttgtttatcttttttaacttgctcaaaaaggcgcttaaccttcagtgatgtgtaattcctccagtcatgcatgctgaagccaaatttgctgatcatttcctcaccagcgtgattggaagatattatgtctccttctaatgataaaataaaaattgcatcaatattgtggacgattaaagactgaaatcgctgttcgttatcctttatgcgttcgctctgtttaataaactttcgatctgcatgggaactgaataacaataacgtttggatacaaaaaataattaaagtaacaaaaattgaccaatgaaacgtttgcacctccatatggcttccgggcggagccatgtccttatggaaagttgccgcaagcatccctgtgtagtgcatgcccgaaatcccaatgcccattacaattgaactgacgactttatagaatataagatgctcagaatgtttttttacggccaagtcaaagaatatttttaacgagacgaaagaggctgcaatcgcaatgataattgaaactgtaaataaaatcggttcgtaaataatcattacccgggaaatggcagacattccgatatagtgcatagaagcaatagatgcgccaagcacaactgatccggtaagcagtctgtaatatgtaagaatgtgccggctgacaaaatataatgacacaaatgatcccgaaacagatgcgccaatggctgccattaaaggcatgaattcatattccatcggcatttccatatggacggccatcatccctacaaaatgcattgaccaaataccgaatcccataataagtgagccgccgatcagccaaattttactttttaagcctgtattgatggtgactttccttgaaagttcaagggaaatatacgaggcggtacaggcaattagaatagataaacatatgagagtcgtattatatgtaacgtgtatttccaaatggagattccccccgtatcgtgtgttccagtcttgttgactctctttattatcggctgcttaaccgcagagtttcagccttcaaaacgatagaaatacgagggagatctatttttagttcaactgaccgtgaaaaatgtgttaaaatcatcttgacgttttccgaaaaaacaaaaatgtataatacataaacatgaaacaagggagttggtggctatcgaagagctggttatgtcatggatagaagcatttaaaagcttatcttattttggaatatttctagcgctcagtattgagtttatcccggccgaagtcgtcttgccgcttgcgggctattgggtatctaaaggcgatatgacacttgccggcgttgttttggcaggatcgcttggaggagtggccggtccgcttacgctgtattggataggccggtacggaggaaggccgtttcttgaacgttttgggaagtatctctttattaaacctgaagcgcttgataagtcagataaatttttcaaaaaacatggtggctttgtcgcgttcagcggccgtttcttgcctggcatcaggacattgatttccataccgtgcggaattgcaaaaatgaatgtttgggtgttttcgctttatacattcattgctatgcttccgattacatttgtatatgtttatctcggtgtgaagctcggtgaaaattggaaggaagtcggctctattcttgatcaatatatgcttccgatcgggatagccattttggcgcttttcctgctctacttactgatgaaaaagaggaagaaacgcacgcactccgaacaattatctgtatttttgaaaaataaacgttgacaaatcattgcgctgcgcatatcattgacgtataaaatcatatttcttgaaatcccaaaggggagtagcgtccggaatgtattccggaaacaaagtcgtcatttcatggattgtatccatcggctttgttggcatgcctgaattcatgtctagcaagacctttgccttatgtcggcaaaggtcttttttgcatggtccggccggcataagatcggatgaagagaaagaaaacaacttttttgggagggtatcatttatggatgcagcattattattagagtatggttgggttcttctcgtcttgatcgggctggaagggattttagccgccgataacgcgctggttatggcggtaatggtaaaacatttgccggaggaaaaaagaaaaaaagcgttattttatggattggcaggggcttttgttctgcgatttggctctttatttgcaatttctttcttggtcaacgtatggcaggttcaagcgattggcgcgatctatttgctgtatatctcagcaagccacttattgaaaagatatgtatttaagaaagaagacacacataaagagacgaagcaaagcggtttttggccgactgttttaaaagttgagctggcagatatcgcgtttgctgttgattccatcttagcagcagtagcgctggcggttacacttcctgggacatcactcccgaagatcggcggacttgacggaggacaatttctcgtcattttggccggcggtatcatcggactggtgatcatgcggtttgcggcttccatgtttgtgaagttattaaaggaacgtccaagcctagaaacagcagcctttgtgattgtcggctgggtcggagtgaagcttgctttatatacgcttgcccatcgcgacatagcggttgtttctgagcactttattcattctggaacatggaagctgatattctggggtgtcttagcagcaatcgcggtttgcggctggtttatgtcaggtgggaaaaaacagccggagggcgcacaaaacgaacaaagaaacagcacccgtgaacgggcgtaatctgaaagactctgcttaaaagcagagtctttttgtgtttgaagcgttttcataagcgaaataaaataacatttttataacatctttgttacaaaaaacacgcataaaacccccttaattctttagaaaggcacgaaatcatgtataggacgtcagaatggtttgtcataattgagacattggaaatcaatatttctttttctcctttgcgaatccctatcaaattagctatcattaatgagtagttatagggaggaactgaggtgaaaccagtgcttagccttttgtttaaattgggaaaaaagaagcaaacacttgaaaaagctgttgagagtatacaaaaaggcaataaagatctgcaaaatgaattaatacagcaatataagccatttatcgcaaagacggtttcatccgtttgtaaacgatatatagatgaaaaagacgatgagttcagtattggactgatcgcgtttaatgaagctatagaaaaatattcacctgaaaaaggaaattctctgctcgcatttgctgagcttattataaaaagaaaagtcattgattacattagaaaagaagccagaagcgcacaaaatataaatatcgatttacaggaaggagacgatcaggagtcatcacaaagcctgattgaagccgagctttccattgatgaataccgccgtcagattgaacaggagcagaggcgggaggaaatcctctattttcaaaagcagctcaaggattatggtttatcgtttaaagaactgcttgaaaattctccaaagcacacggatgcaaggcaaaacgccataaaggtggcaatgacgcttgttgaacatgaagaattggccgctatcctgtatacaaagaagcagcttccggtcaaacagcttgaacagcttgtctctgtaagccgaaaaacgattgagagaaacagaaaatatattattgcgatgtgtattatcattacgggtgattatatttatttaaaagattatcttaaaggggtgctgcactcatgagaagagggattatagtagagaaaaataaaaaattcgtcacgttgctgacccctgacggacaatttttaaaagccaaaaatgatcgacacagctatgaaatcggagaagaaatcatgcttccgagtgaaacacgcatgggcagaagggccagcttttttgatttttttaaactgcgccctttcaaaatggggatttttacgatgactgctattatgctctttatttttatagttctccccgttttttctaataataaggcctatgcgtatatgacaatcgatatcaatccaagcgtcgaaatggcgttaaacagcgattatgaagtgattgaactgacgcctctaaacgatgagggacagaaagtcgtgaatgatatagatgattgggagaagactgattttaaaaaggtgattgacgatattataaccgactgcagtgaacacgggtatgtaaaaaaatcgaaagaaatattgatttccactgtttatgaaaacacagaagacaatacatataaaaaggctgtgaaaaaacagctgaatgatgtgactgaaaaatataaaacgacataccgcatggaatctctcgagtcagatatgcaaacgagggaaaaagcgaagaaagaaggcgtctcaacaggcagctacatcaaatcaaatgaaaagaatgacaataaagatataaaagatgactccagcaaaccatccggggaagaggatcaaaagagtgatgaaaatgaggatgaaaacaccgatcaaactgacacccaggacagcaagcaaggagataatgaacagctgaatgatgcggattccggagaccagaaagaagagaaagcggatgaccagattgatgatagtgacaaagataaaaaaataaaggaatcagatgaaaacacaaataccgaaaaagatggggaccatgagcaaaccccaatacaagatcctcaagataaaggaaatgaaaataacggcgttgacaagggccaaagccaatatcacagggactggaacaatggtgaacaaggcaagaaccgttcttcgtccagaagggataacgcttcagaccgacgtaatccaaacggctacagcagtgataatcattcagctaaaaatgaagattcgccgagtgcccccggcgaataaagacctgaatttatttagttgtgccatttaattgtgattgtgcttgctgtaccagccgctttgtcatttctccgcctacagagccgttagcgcgtgcgactgtatcagaaccaaggttcacaccgaattcttgagccacttcgagtttaaattggtcaagtgcctgctccacccctggaacaacgagtttatttctgctcgccatctttttcatctcctttttcgataaagaaattcttaacgcgtatttagtttgaaatatacggggtttatttatgctggcaattgttgtggagaaaaataaaaccccggcctctgagccggggtggcgcagactatagaatgtctgctgtcattttatgtgcggttgcctgaatatggaatgtcaaaatggagaggactgtaatggcgataatctgtctgattttaagccattggctgtcattcagttcttcaaaacggtgacggagacgctctgtctcctgttcggcgatctcctgcagatttgattctttcatagaaggagtatcttggtgatggatggcatcaagcacatatgcgcagctttcataataagcaatcgggctgatgacatcatcagatctgtctgagattgtgttaaaggccacttttaaaatagctcgtatgtgttcaaagtcataaatggattttaaatcacgtacaattaaaagaataactgcctgttcaattgagtattttttgcctagctcagggtgtccgatcagatctttgatatcacgctttacccagttttgaatcgcggttgactttaacgaagtcagctcgcataagttgccaagctctacgatttcatttgtagacagtccgtattcttttttctgtttttttcgttcatatcttgtaagaaattcaggaatttctagatgattggctgctttttctgctgacatgttcgctgattggacgagaatgtcgagcgggctatgttctccttgtccttttagggaatagagcagccgcaccatatcggttcgagagagtttaaaaatgttcattgttcacctctttaaacaatttgacgcggatataggtctatgtataagttcaaaattcaagcgtcagcaaattacattaacatcatacgtcgaattccttgcattttcaaatggatgttttataatttaaatatacgggttcttttgaacttaaaataacggaggttgttatggcgaaaagaatttttctgtttattctaacgaatattttggtgcttacaacaatcgggatcgttttgtctgttttaagctctgttacaggagtcgggacgtactttacagctgatggcggtatcgatccaatggcgcttcttgtgttcagtttagtcgttggatttgtcggttcctttacgtctcttgcgatatccagatggatggcaaagacgatgatgggcgtcagagtgctgaatccgaaaaaacactcgctcagctatgaggaacagcaattggttgatcgtgttcacagattaagccgctctgccggtttaacgaaaatgccggaagtcgggatttaccgttcacctgaagtaaacgcgtttgcgactggaccgtcaaaacgccgttcacttgtcgcagtatcgtcagggctgctggagcagatggatgacgcagcagttgaaggtgtgcttgcccacgaggtcgcgcatattacaaatggtgatatggtaacaatgacgcttttacaaggcatcgttaatacctttgtcttctttttatcgcgtatcgccgcttggatagcaagccgttttgtcaaagaagatctagcgccgatcgttcattttattgcaataattatttttcagattgtcttttcgatacttggcagcctggttgtgtttgcgtattcacgccatcgtgaattccatgctgacaggggaggagcggatcttgccggcaaggacaagatgattcatgcgctacggacgcttaaaagctattcttcccggattatggaagacgatcagacagctgtccaaacgttaaagattaatggcaagaagcgctcttcgcttttctctactcaccctgatttagatgagcgaatcaggcggctggaagctaaataatacaaacacattgttcctctgagagaattctcagaggttttttattttatccattgactaaaatcataaaaaaataagcaagttaagaaaatgtttcgtaaaagcctttaaaaatggacctaatatctttagaataattaccgtacttaaaaagagaggcagaaggattttacatgagattaaagtttggaaaattgatacaggccttgtcaccggcccagctgatcgcattatattattttcttgcagttactgtggccgttatattgctgagtttgccggcggcccataaaccgggggcggattggacgtttattgatgcgctttttacagctgtcagttcagtcagtgtaacagggctgacagttgttgatacagctgatacattcagcacaatagggatttttatattagcatttgttctgcaatttggcggaatcggaattatgacgctcggaacattcatttggctgatcatgggaaaacgtatcgggctgaaagaacggaagctgatcatggttgatcaaaaccaatcccagttttcaggaattgtcaatctgatgaagcaggtactgtttctgatcttgtggattgaattttttggcgggctgattctcggcacatatttcttaacctactatgactcctatcaggaagcttatttacacggattttttgccagtatcagtgcaacgacaaacggcggatttgatattaccggtaattcgatgattccatttcgccacgattactttgtgcagtttattacaatgcttttaattatatttggagcgattggatttcccgtgcttgttgaagtaaaggatttcctgttttcaaagcatcggcgttatccatttacgctttttacaaagatcacgacgattacgttcggctcacttgtcttgtttggagccattggcatctttgccctggaagcaaaccatgcgttcgcaggaaaatcatggcatgatattttgtttttgtccctgtttcaatcaacggcaacccgaagcgggggactggcaacaatcgatatcagccaattatcagattccacactcttttttatttgtgcgctgatgtttatcggagcgtcgccaagctcagtcgggggaggcatacggacaacgacttttgctttgaaccttcttgcgctgtttcattttgcccgcggcaataaggccgtaaaggtattcaaacgggagcttcaccctgctgacttgatgaagtcgcttgttgtcacgatgatggcgatcctgctcgtttttggcgcgacactcattctgaccattacagaaaaacattccctgctggagcttttgtttgaagtgtgctcggcattcggtacaaccggcctgtcgcttggaattacggcagatttgagcagtgttggaaaatgcgtcattatgattgtcatgtttatcgggcgaatcggcatcctaaccttcctgtatctgatcggaagaaaggaaattgaagcgaactatcactatccgaaagaaagagtgattatcggataggcaaaacaccgcatactttgcggtgttttttgattgccaaaaaaaagatgtgtgcctcctgttcagttggagaacctaacttcgacaggtgcaatttacgctcctgcatcttaaaatgtctgaaaactggcgaggaggattcgtatgaagcgtaaagctgaagtgaatgaagccattaaaaataacaatacacctaccgagagcatggaccccaattcatataagacacaatatcatgacgaccccaattttagaggggcaaaccgcaattccaaacagggccagcagggaggcatgtagttgtgaagaaaaaccgtcatagcagagacatgcaaaatcataaaaagcctatgaataaaaaggtgctggaggaagagttctcaagtgaacttggggattacaatgccgggaagatcatcgaaacgctggaagtcaccaagcctgaaaagaaaaaagaaaaaaacaaaaataaaaaacaaaaataaaaaagacctcttaggcggcgtccgcttaagaggtgctttttctattttaaataagcatttttgcccgttcctctgacaaattgcaataagctggtcatcctcagctcaatgaagggctgagcgactgtcttaacaaagttgctggagaggactgatgtcagggctgctgttaaaagcaagaggatcactaagctttgatagtcagtaagccaatcctcaagcccgacctgtcgtaatgtcttaataataaacccgtgaagcagatacacgtaaaatgtccgggttccccatttggtaaagaaataccgtttttgcggaacaagcgctaaaaagctgaaggttgccccaaaggcgagtacataccagccgattcgggatagtccgcttaccagggtaacgtctccaaatgaagaatacggttttgaaccaaacagaaaagaatagtcaaaatcgatgccccagcagatgacgaatactgcggcaagcactccgagcgcaatttgtttgccgcgttttgatctcaataaatcaaaatgatgtttatttaaataaaaaccgacaaggaacatcggtaagaatacgaatgtccgtgacaagctcagcgtgctgctgacaaagtccagataaccgatcagcacggcgattccgcagctgacaaacagcgcccactgctttgaaagctttgaaaaaggatataggagcaggttccaaaagaataagcttacaagaaaccataacgaccattgcggatcaatcgggttcacatttgccatgctttcatcttgcataatgtaataaaagacggaataaatgatttggaaaatcaaatacggaataatcagcttgaccgccagcttttttacatatcccgcccgtttaaagcctttcgcgaaataaccggatacaagaataaatgcaggcatatggaatgtgtaaatgaacttgtagaggtagagcataaaatgattatcattaataaaggaacgaaggatatgaccgaatacaacaaggaatatcaataaaaattttgcgttatcgaaataactgtcccgcgatttactcatagcatcaccttctctttcatcagtcactaagagattattccctgctggtacatattttaaaataaaagatgaaaaaggaatctaaaaaaatgctgattgttaggtcgatgtaaagtgatggtaaggatcgtagaaaatgtcttcgtaatgtaatggcgctgaaattttctgaaatttatagggcaaatgaaggaagttcccgcattttgtagaaatattgagggataggttttgaagaaggagtgtacatgcatggaaactcttggtgtccagacaaactcggagctgcgagaggaactgaatcgcctcaaagaagaaaacgcgcgactgaaaaaggaattgaatcagcatcaagtgattgtcaacaatacgctcgatgctatttttatttgtgataacgaaatgcggattgttcaggcaaatgaagcaacagaaaggatgcttcaagttgactcggaggatttgaaaaagcgttctgttttggattttttgttttcaatcccaaaggatgaactgaatctttccgtaaagaagttttttaaaaaaggctttctgtggaaggaggttccgatcaggcttgattgcggggcaacaaaatacatagagtttctggccaaaagaggtattggcgaggatttcttttttgttgtcatgagggacatatcttctaagaagattctggagcgggaattctctatgaatgaacagctttttaaggacttgtttgacagagcagttgacggaatcgtcctgtttgataaagatggcggttttattgatgccaatttgtccttttgtaaaagctttgaaatcaatcataatgagctgtctcatttatcgttgtatgagttcatagacagcggctcacgaaaagatttcgacaatatctggaaggcgctcaaccgcaagggaaaagcgaagggggagctgcctgtcaagcttcgttcaggagttcaaaaactatttgaattcacgattacatcaaacatcatcagcggtttttatatgtccattatgagggatatcacagagaagcggtctatggagctacagctctttaaaagtgaggagcgcttcagagaaatctttgaaaatgcaatggacgccatcatcatctggtcgaatgacggaagaatcgtaaaagcgaatcaatcagcctgtaaaatttttgagctgccgatgaatttgctgttgaaaagaaagctgtgtgattttctcgttgactcgcagcagaaatacagcataacgaagaggaaatacgcaaaatacggagagatcagagaagagctgctgtttcaaatggggaacggccaattcaaagagcttgaatttacttcaaaacggacaatccttgaaaatcagcatttgacgatcttaagaaatgtaagcgacagaaagcggatggaaaaggagcttcgggaaagcgagctgaaattcagaaaagtgttcaacggctcaatggacggcaatgtattgttcgacaatcaatacaggatcattgacgccaacccgttagcaagccatattttgggactgtcacatgaagagataaaacagcacagcttgttagatattatttctgcttatgaaatagaaaatctggcatcaccggcaaggcagattaattttgatgaaatggacaacgaaattccatttttgctgagcagcggtgataacagaaaactcgaattctcatttaaacggaatattattcaaaatatgaacttggctatctttaaagacgtaacagagcgaaaagaattggaggaacgcctgcgcaaatcagatacccttcatgttgtcggcgaactcgcagccggcattgctcatgaaatcagaaatccgatgactgctcttaaaggcttcattcagcttctgaaagggagtgtcgagggagactacgccctttacttcaacgtgatcacctcagaactaaagcgcatcgaatccatcatcaccgaattcttgattttagctaagccccaagccattatgtatgaggaaaaacatgttacccaaattatgagggacacgatagaccttctaaatgcgcaagccaatctcagcaatgtacaaatgcaacttgatttaattgacgacattcccccgatttactgtgaaccgaatcagctgaaacaggtttttatcaatatattaaaaaacgccatcgaagtgatgcctgacggcggaaatatttttgtaacgataagggcattggatcaagatcatgttcttatctccttaaaagacgagggaatcggaatgacagaagataaattaaagcgccttggtgaaccattttatacgacaaaggaacggggaactggacttgggcttatggtaagctataaaattattgaagaacatcaaggcgagattatggtagaaagtgaagaagggaagggcaccgtttttcatattacgcttcctgtcagacagaatgctgaagaaagaaggaatgatgaatgaactactatacgacagccgagacgccgctcggtgaacttatcattgccgaagaggaggaccggatcactcgtctatttctcagtcaggaagattgggtggattggaaagaaacggttcagaatactgagcacaaggaaacacctaatcttgcagaagcgaaacaacagcttcaagaatatttcgcaggcgaaaggaagacattctccctgccgctcagccaaaagggcactccttttcagcaaaaagtgtggcaggcgctggagaggattccatatggcgaatcccgaagctatgcggatattgccgctgcggtcggcagtccgaaagcggtgcgcgctgtcgggcaggctaataaacgtaacgacctgccgatttttgtcccgtgccacagagtgatcggcaaaaacagtgcgttaacaggatacgccggaagcaaaacggagatcaaagcatttttgctaaacatcgagcgaatctcctataaagaaaaataaaacatatggcacgttcccttttttcacggccgacatatcattttattaagttaaaaaagttggtctgatgaaaaaggaggacaaagcaattgaagccgagccgctctgagaaacttgccgtttttgccgaactgtttgtgaaactgcatatcttatcaagcgctcaaaaagatgaaatcatcaatgttaacaaaaagaaacaaaaaaaccgctgactcggctccaaatgagcaaagtccagcggttttttaatgcaccttttctcctctaaacagctgttcaatctcttcttcatagtttccggtcataatccctttttctgtgatgattcctgaaatgagatcatgaggtgtaatgtcgaaagcgggattaaagacaggcacattggatggagcggtccgaactccggaaatctgcctgacttcctcgggatcgcgttcctctatcgggatatcagcgccgcattcgacctttgtatcaaatgtagataaaggtgcggcgacaaaaaacggaatatcaaaggcgtttgctaaaatagcaagaccgtatgtgccgattttatttgccgtatcaccgttctttgcaattcggtcggctccgacaataacagcggaaatttgtttttccttcatcgtatgggcagccatgctgtctgtgattagagtgacatcaatgcccccctgcatcagctcccaagcagtaaggcgtgaaccttgcaggacaggccttgtttcacaggcataaatgtgtaatcccaaatctttttgtttggccaagtaaaacggagctagcgccgttccatagcggcttgtcgcgattgagccggcattgcagattgtcatgatcctgtcgccttttttgaaaagctgcagggcgttttggccgatcaaccggcacgtttcctcatcctcgacctgaatctgaatggcttcatggacaaggtttgtttttgcttcatttacggaaatcgcgttttcgaccgaatgactcagtctctcaagcgcccatgacaaattaatggcggtaggccgtgagctgtttaaatattgtttgatgtcttccagtctgcggcggaattccgtgacattatctgtttcaatgtttttggcagcaagcgccagtccgaaggcagccgtaatgccgatcgccggagcgccccttactttgagcgtgacaatcgcatcaaatacatcctctttcgtcgtcagctccaaatattccgtctcatcaggaagcttttgctgatttaaaatggtaatagctgtttctttccattcaacagaacgtggaacagcaaatgaatgggtcatgaatagatcattcctttacaagtaacttaaataattcaataacatctgttatcgttttgaattccgaacgtttttcgataaaggctgtgccggtttcgagcgccaagcgttttctgccgattcgtttatcaaacggcacgatcgtatccaggtcagctacatgggcaaggccgatcgtgcgtcgtatcagctcacagcccgcaaatccgattgcttcttcaaaaatatggctgagcgtatcagtgaggtaaccgtcgatgttggcgtaaacatccagactgtccttctgccaggattcactaaacgtctcttcaaacgtttcccagacctttttgacatgttcatataacggctctctgtcagccccgtcacggctgagtgcgttcaaaaataagttggcgataaattgccctacatcaaagccgatcggtccgtaaaaagcaaactcaggatcaatcacctttgtttcgtgctcacttgcgaaaatgcttcctgtatgcaaatcaccatgaatcaacgtttctgcagacgttaaaaatgactttttcagcttagcggcttcgattttaacgctgtcattattccaaagcttttcgacaaaaggacgaagctcttcttcaaaatcatttgtgtcatggtcgaagaaaggatctgtaaaaacaagtctttccgtaatgtcgcatagctctggatttgtaaactgtttaacaagctgttttttcaccttaggttcaagcgcgtaatctgatgagtagaaaagtgtttttcctaaaaattcaccgatgtgctgcgacagatgaggatagttttcacccttaatgagtccttttcttgcgatcttgaggtgagagagatcctccatgacggtaaccgccatttccgtatcagaataaaacactcttggaaccaggtgaggcacatgctcgccctgacggatgagagcgctgctttcgattcttgcacggtcgattgtcagcggccagctttctcccaccacttttgcatacggaaccgcctgtttaatgattaatgctctgtcatgttcttgatcataaatatgaaaaacgtaatttaagttgccgtctccgatctcctggcatgtcagcgtgcttttgcttggaaaaaggccaagcttcaccgccaacgccacagcggagctttcatttaacgtttcgtataaaggtgtttttgtgactcccatcatcataacctccaattatgtaatcacttaatatgtagccgtaaaaaagcctccttctcagagagaaggaggcttaacagtctatgtccgcctctcttatctctcagatcagatctgaatggaattagcaccgtgccttaagagaccagcgtctcggcgcgaaaaagatgcgccccatttcacaatggaattacggtcggttgctgttggggtcaaaaggccaaatccctcgcccaactctcgataagagaatatattcacttgtttgacaattctaatttatcagttgatgaacatggtaacaggtaatttagttagttgtcaatattttttaatataaatcttttctgatatcatcgaaaacaggaatgctctcccgaacttctgcgctttcttgaaggtcgatttccgctcggactatgccttcttcccggccgccttcagcaagtacacgtccccatggatcaataatcaggctatgtcctgcaaattcattatccggatttgaaccggtacaattgcaggctgcgacaaagcattggttttcaatggcccgcgcaataagcaggcttttccaatgatcaaggcggggaagaggccattccgcagaaataaacagcacgttggcgccttttgtcgtatgttttctgatccattccggaaaacggatatcgtaacagatcaatccagagcttttgacgccgtcaagctcaaagtatccgtcttcggaaccggctgataaatacagatgctcatccatcagctgaaaaagatgggcttttctgtactctttaatgatttgcccttccttatccgcaatgtacattgtattataaacatcagaattcttcctgacagcgaccgacccggcgacaatatgaacaccatgtttttttgccgttttcttcagccagctctgagcggagcgcccgtcttcgtcagcgagttcatcaagattggccagatcatatccggtcgtccataattcaggcagaacaagaacatcagcatgtttgctttctttttcgatgaaaaattcagccttttttatattttccgaaggtttgccgtatgaaatatcaaattgaagacaagatatcgtccatttcatctttttaacaccccaaatttttctttacttttttcatttaaccatatatgatgatggactatcatttcaagatttttttagaaggtgagaatagatgaaatttgaacagtctcatgtattgaaggaattgcctaaacaattcttcgcttctctggtgcagaaagtgaaccgaaagctcgcagaaggacatgacgttatcaatctaggacagggaaatccagatcagccgactcctgaacatattgtcgaggagatgaaacgagctgttgctgatcctgagaatcataaatattcgtcttttcgcggctcataccgtctgaagtcagcggctgctgcattttacaaaagagagtacggcattgatctggatccggaaaccgaagtcgctgtattattcggcggaaaagccggtcttgtcgagctcccgcaatgcttgttgaatcccggtgatacgatcttagttcccgatccgggttatccagattactggtcgggtgtcacacttgcaaaagcaaagatggaaatgatgccgctcgtaaaggacagggcgtttctccctgattacagcagcataaccgctgaagtaagggaacaggcgaaattgatgtatttgaattatccgaataatccgaccggagctgttgctacttctgagttctttgaagacaccgtgcgttttgcgactgaaaatggaatctgcgtcgttcacgattttgcttacggcgctgtaggatttgacggctgcaagcctttaagctttttgcagactgaaggtgcgaaggatatcggaattgaaatttacacgctgtcaaaaacgtataatatggcaggatggcgggttggctttgccgtcggaaacgcttcggtcattgaagcgatcaatctttatcaagaccatatgtttgtcagtcttttcagagcgactcaagaggctgcagcagaggcactgttagccgatcagacgtgtgtggcagagcaaaatgccagatatgagagcaggagaaacgcttggatcacggcatgccgggaaatcggctgggatgtaacagctcccgcaggttctttttttgcatggctacctgtgtctgaaggctatacttctgagcagttctcagatcttttgctggaaaaagcgaatgtggcggttgcggctggaaacggcttcggtaaatatggcgagggctacgtcagagtcggacttttaacaagtgaagaaagacttaaggaagccgcttatcgaattggcaaactgaacctgtttacccaaaaaagcattgacaagaccttataacgatgggataattcaaaataatttataaaatctatattttcttatcaagagcaggcagagggacgagcccgatgaagcccggcaaccgacttataaagcacggtgctaattcttgcagctagcggctgagagataagattcggacgagaaacgaaacctctttagacgcgattgcagtttgaagaggttttttgatatggatgaaaatgaaaggagctctggcatgagtgagttattagcgacatatctcctgaccgaaccgggagccgatacagagaagaaagcagaacaaatcgcaacaggattgacagtaggctcctggactgatctgccccttgtaaaacaggagcaaatgcaaaagcataaggggcgggtgataaaagttgaggagagagagggaactcctgcatcagcaaaacaagcggtcatcacaattgcctatcctgaaatcaatttttctcaggatattccggctttgctgacaacagtgtttggcaagctgtccctggacggaaaaatcaaattaatcgatcttcacttctctgaagcatttaagcgtgcactgccgggaccgaagtttggcgtatacggcatccgaaagctgctgggagagtttgagagaccgctgttaatgagcatatttaaaggcgtaatcggaagggacctgagtgatattaaagaacagctccggcagcaggcgcttggcggagttgacttgattaaagacgatgaaattttctttgagactggtctagcgccttttgaaacaagaattgcagaaggaaagcaaatattgaaagaaacgtatgaacaaaccggtcataaaacgctgtatgcggtgaatttgaccggacgtacggctgatctgaaagacaaagcgagacgcgccgccgagttgggagcggatgcgcttttgtttaatgtcttcgcttacggcttggacgttatgcaaggccttgcagaagatcctgaaatcccagttccgattatggcgcatccagcagtgagcggagcgtttacgtcttctccgttttgcggtttttctcacgctcttttactcggaaaattaaaccgatattgcggtgctgacttcagcctctttccgtctccatatggttcggttgcgcttccaagagcagacgcactggcgattcatgaagaatgtgtgagagaggatgcttttaaccaaacatttgcggttccgtcagcaggcattcatcccggcatggttccgctattaatgcgtgatttcggcatagaccacattattaacgccggaggaggcgtacatggacatccgaacggtgcccaaggcggggggcgagcgttcagagccattattgatgcggtcctagaggcccagccgattgatgaaaaagccgaacaatgcaaggatcttaagcttgcgctagataaatggggaaaggttgaagccgtatgacgactcgaaaaccttttattatttgtgattttgacggaaccatcacgatgaacgacaacattataaatatcatgaaaacatttgctcccccagagtgggtggcattaaaagacggcgtactttccaaaacgctgtcgatcaaggaaggtgtcgggcggatgttcggccttctgcccagccgtttaaaagaagagattacaagttttgtattggaagatgcaaaaattagggaaggctttcgggaatttgtagcatttatcaatgagcacgagattccgttttatgtcataagcggtggaatggacttttttgtatatcctttgcttgaaggcattgtggagaaagaccgcatttattgcaaccatgcttcatttgacaatgactatatccatattgactggcctcattcctgcaagggcacatgcagcaatcaatgcgggtgctgtaagccgtcggtcatccatgaactttctgaaccgaaccaatatatcatcatgatcggtgattcggttacagatgtggaggcagcaaagctgtctgacctatgctttgcaagggattatttattaaacgaatgccgggagcaaaacctcaatcatcttccgtatcaagatttttatgagatcagaaaggaaattgagaatgtaaaggaggtacaggaatggctgcaaaacaagaacgctggcgagagctcgctgaagtaaaacgggaattggcagagagagattggtttccggcgactagcggtaatctatcaattaaggttacagatgagcctttaacatttctcgtcactgcaagcggaaaagataaacgtaaagagacggttgaagattttctgctggtcgatcaaaacggagagcctgctgaaagcgggcattctctgaaaccgtcagcagaaacgcttttgcatacacatttgtacaataaaaccaatgccggatgctgcctgcatgtccatacggtaaacaataatgtgatttcagagttatacggagaccaaaagaaaatcacattcaaaggccaggaaattataaaagcactcggcttgtgggaagagaacgcagaagtgaccgttccgattatagaaaatccggcacatatcccgacgcttgcggcactgtttgtggaagagatttcagaagattcaggagctgttctgatccgaaatcatggtattacggcttgggggaaaacagcatttgaggcaaaaagagtgcttgaagcgtatgaatttttgttcagctaccatttgaaattgaaaacactccagcatcagctggttaaataaaaggaggaattgaaatggctacaattcgaattcatgatgaggcaaatacaacgattgaaaatcaagaggaagtggcaagctttctggacagtcaagaggttatttatgagcaatgggatatcacgaagcttccggaacatctctcagagaaatatgacctgacagaagaagaaaaacagcaaattcttgataccttcgaaactgaaattaaagatatctcaacccgccgcggctataaagcacaggatgttatttcattgtcagacagcaatccgaaacttgatgaactgcttgaaaactttaaaagagagcatcaccatacagacgatgaggttcgttttattgtaagcggacacggtatttttgtcattcaaggcaaggacggcacgttttttgatgtccgtttaaaccctggagatttaatctccgtgcctgagaatatccgccattacttcacgcttcaggaggaccgcaaagttgtcgcggtgagaatttttgtcacaactgaaggctgggttcctatttatgaaaaagacagcgtgaatcaataagcatgagatagccccgttcatcgaacggggctttttatatttattgcaaacgccacttttcatactgtgacagttcttttttaatcattgtccaaatcaaacctaaaacagctgcatcgtcaatgaatccaagaccgaggatgacgtctggaatgatatcgagcggcatgacgatatacaggattgcggcagttaacagcaaaagtgttttaacctgtgaacgagggtagtcgccatttcgccaatcgcgaagcatctgaaaaaaagtagtgatgtgctggatacatttttttcggtttttcctcttcaaaattgcttttccgcctgccgctccgagcataattgctttctttttcttcattgggcatacctcctgcctggcggcgtgtttaagatattcttcacctgggtattgttcttctaatcctatcaatatatctattatacctgaaaaattaacttatttaatgaaaatatgtttacaaataaagtataatctgtaataatgcacaataacccaatcaaacttgtttcctatttcttagcggcgaggggtgaagtgaatgggcggttcttctgaacaagaaagattgttggtgtctattgatgaaaaaagaaagttaatgatagatgccgctagaaagcagggatttacagggcatgacacgatcaggcacagtcaggagctggattgtttaataaatgaatatcaccagcttatgcacgaaaacgaacattcccaagggattcaaggccttgtaaagaaattaggcttgtggccccgcagagatgttatgccagcatatgatgcaaataaatagcggcctatcagatgcatatataaagagagagcttttcggaagcgctctttttttctggaaaaaattcatatgaaagggggaactaatgaaggaactggcgattctcattaccgaaatggtcaatcaatttcatgatgcttttatttccttatgcggaatatttggcatttatttaactgacaaagaaatgcatttttgggtgatcggcatttttggcatattctttttcggcgtcactcacgctgtgtttacatggctttctaaatggagtatgacagccttgtcctttatctataccgttacagtcatcattgtcatcgtatttgcgattgagattcagcaaaaggtgacggggagagggaatatggagtttttagatgccacggaaggtataaagggttttttagtattttttatgttttttttgcttttgaaaatgctgttgcgtttcatcaaaatccttttttctggaagaccagcaagcaaatcgaatggcaatacccgatcacgaagataaaaaaccctcctgacatggtcaggggggttatgaagcggatacagggagggtgattgtcacctctgtgcctcttcgcacttcactttcaatatgaatagagcctccgtacatcagcacgatccgtttacaaacaacaaggccgagaccggttcctttttctttagaagtaacaaagggaaggaagatgtgatccagcatttcctgagaaatcccttcaccgttatccacaactttgattatggcttttttatctaaagctcccagggagatcgtcagtttgcctccttcaggcattgactcgaggccattttttgctacatttaaaatcacttgtttaatatgatcttttgtacattttacgagtaagggctgctcggttaaatactgtaattcgacttcaacattgtatagattgccctcagaataaatgatcggcataatttctccgataatgtcctgaagtgagttcagctcccatttttcagctgtcggcttgccgagaacaagaaactcactcactatttgattgatgcgcttgatctcctgttcgataatggagaagtaaagctgatcttcctcacctttatatttcttttgcaacagctgaataaagccgcttatgccggtaagaggattacggatttcatgggctgtgctggcagcaagcgtcccgatcagctctaatttttgcgcctcattttctgagcgctccagctgggtctgccgcttcagcaaataatacagcacgagaataaaaaggatattcagcagaacaataatacatgaaagcggaagcacaaggcttttcgtcagttcttctattgtgaccgggttcggatagactttcatattccagctgatatcatccagatatccgctgacaggtttctgatcctctgcatgagatgcttgtccgctcgcaaaaatcattttcccgtcttggttcacaacttcaatataaacatcagggcttagtaagttaatgagatttttcaaataatcaatttgaatagctgcgacaagataatctgtcacattacgttttgagtccaaaacagggacacaaattgtgaaaattggctgaccagtaattctgctcgaataactatctgaaatgactgtctttttagtttcctttgcttttgtaaaaaaagatctgtcggccaggtttacattcgtttttaattcggttgtgcttgcggtgacgtctcctttggcattgagaaaatagagaccggaaaatctcggctctgaatcaaaggtcttttccaaaattgactgcattttctttatatcaaccggtctgtcaatggcgatggacaaggaggtcattctcgccattgtttctccgattaaataattgattttgttgcggtgaaggtttagcaggacacttgcttcttgtttatgttctgcagctattgtatctttttctttttcatatacgaaaaagctgatgacgattgccggaatcacgaccagtatgatataaagtttgactctcccgcaggcgccttttagtattttcaatttgcatcgctccaacatacacctgattagaggtattatatcattgtttcttcttctttaataagaaaaaataaccaaaaaaattagaaaaaggtgttggcaagcttacattttaaaaaagaagagaaatattggaaagatttttattgacattttggtctttgtttattaatgtttctctgtaacggtttctaaaaggatgattgagacatgacagaaaaatcactgaagttatttatcgtgctgtcgcgcgcgtatcggtctattaacgatcatatgaataagcatattcataagcatgggctgaatccgactgaatttgctgtgctagagcttttgtaccataaaggcgatcagccgctgcagcagataggagataaaattctcttggctagcgggagcatcacatacgttgtagataagctggagcaaaaagaacttctcattcggaaagcgtctcctacagacagacgagtgacatttgcgcaaattactgaaaaaggcatcggtcttttgaacgatattttccctgatcacgctgctgaaattgatgaaatgatcagcgtattaagcgaagaagaggtagagatgtgcaccgaaatgttaaaaagagtaggattaaacgcaaaacagtttcataataagtaaaaaaaggaagcctgatatgtcacaaggcttccttttttgctatttttcatttgtttccgctgcgcctctcggcaaaatgagaacttcaacccgccggtttttgcttcggccttccgcagttttattggaagccaccggtttatactcgccataacccttggcgctgaacacttttgcatcgagcttggggttttcaatcaggagccccataaagtttaccgctctcatgacgcttaaatgccagtttgattggaattcagaatttttaattggcatattatcagtatgtccgctgataatgatatttcttggcgggttaatcacaagaagatttgaaatctcttttgcaagcggcacatcttccttacggatggtcgcttttccagaatcaaagaagatgctgtctttaatcgtaatcagaaggccttcactagtcatcttcgtctccagctgatgttccagctttttatctttgatgaacttttccacctggctcttcacattttcaagttcttcttgatcagctgctttttctttttctttcttgtttttctctttctcttctttttcctttttcacttcatcgatgccgtctgactcgttttcaggaggagtgacactggagtagtccagtacaccggtgccgcctgtaaagacttcattaaatgattttgagagcatttgaaacttagctgcgtcaatcgagctgctcgcgtacagcacaataaacaatgccaggagaagagtaaggatgtcggcgtaaggaacgagccatgattcatcaacgtgctcgtcctcatgcttcttcttcttttttctcgccattttgcgcctctccttgttctgcaaatttcaagcggtccttcgcaggaagatacattaaaagcttttgttcgatgactttcggtgcttgtccttctaaaacggataaaacaccttcaatcatgacctcacgcagttttacttcttgttttgattttcgttttaatttatttgcgaaaggatgccataacacataccctgtaaagataccgagaagtgtggcaacaaaggcggcactgatggcgtgtccaagctcatctgtattgtccatatgagagagagcggcaatcagcccgattacagcgccgagtactccaagtgtcggagcgtacgttcctgcttgtgtaaaaatagcggctccggcttggtgtctgtcctccattgcttcgacttcctctgtcataatatctctgataaattccgcgctttgcccgtcaacagccatgctgagcccgtttttcaagaaagcatcatctacatcctcaatgcttgcttctaaagcaagcagaccttcgcggcgtgcaagctgagcccattcagagaacataggaatgagttcctctattgtgagctgtttattttccttaaataacactcgaaacagcgcaggcacttttttaatttcttttgttgggaacgcaataacgactgctgagattgtcccggcgataataattaaaatggcagcggggtttgcaagggcgctgaaactgacgcctttcagaaccatcccgacgctcaatgccacaaaagcaagaataataccgattaacgaagttttatccatagtttttcaccaaatccttttttactatcttgtctatggttaatatcggttttggtgcccggaactttagggacattgtgaatttgttcatgaaatattcaaggaagaggcatagaagggagaaataaacaaaaacgggctctccaaaattgaaaagcccgggtgtctactgaaattagcagctttcttgcaagctgtccttcagatggtattcatataatagtagaaatacatattcactgtatataaacatgttccatccctccttaaaaaaagtgtaaaggatgaagggaagtagcgcttcaggggaagggacggtattttctaagtcaagagtatgaaagcataaaaaaagcggcttcctaaaaggaaaccgctgattgttatttcgctcgcactttgattttatcatcttctaaaatcacgtgaaaacttgtgatctcgccattatcaagcagcagatcggtcatttcatcctcaacccattcttggatggttcttctaagcggacgtgcaccgaatgaagggtggtagcccagctcagcgattttttctttcgcttcatctgtcacattcaagctaatgccccgttccgccaatgtttcttcaagttctccaagaagaaggctgacgattttgacaagatgttctttttccaatgagcggaactcaataatgctgtcaaaacggttgaggaactcaggtttaaagaacatgctcagtgaatcaattaatgtttgttcttcgatgacactgtcatctgattggaaaccgactttcgtttgtttctcaccagcacccgcattacttgtcatgatgatcacagtgtctttgaagcttacggttctgccttggctgtctgtcagacggccatcttccataatttgcaggaacatatgctgaacgtctgggtgtgctttttcaatctcatccagcaacacaatgctgtaaggattgcggcgcactttctcagttaattgtccagcttcctcatggccgacatatccaggcggtgaaccgataattttagatacggcgtgtttctccatgtattcgctcatatcgagtcggataatagcgtcttttgtgccgaataattcatctgccagtgttttagaaagctctgttttccctacgccggtaggaccgacgaagaggaaggagccgactggtctgtttttggattttaaaccggcgcggcttcgtcttaccgcctttgccactttttgaacagcggcttcttgtccaatcacgcgttcatgaagttttgcttcgagttctttcattttcgtttgttcgtctgcctgcagtttgccgacagggatgcctgttttttgttcaacaatttcctgaatgtgctcagcttccacagtgacagcagtatgagcggaggagctgttcagttttttctccaatgcgagttcttcatcacggagttttgcagccagttcgtaattttcttcttccagggcttttgttttttcggcttcaattgcagttaagcgttcagcggcatcctcatcattcagttcatcaattaacaggttagcttttgaacctgcttcatctaataaatcaattgctttatccggcaggtgtctgtcctgaatgtagcgggatgataaagtgacacacgctttgattgcttcatcactgaatgttacgccatggtacgcctcgtatttgtctttaatcccttgcagaatgaggatagcctgttcaattgaaggctcctgcaccatgacaggctgaaaacgtctttccagcgcggcatctttttcgatttgacgatattctttcagtgttgtcgcgccaatgacttgcagttcgcctctggctagggccggtttgagaatgttgccggcgtccattgatccttctgcagagcctgcgccaacgagaaggtgaatttcatcaatgaacagaatgacattttttcgttccttcagctcagtgatcagctgtttcattctctcctcaaattggcctctgatccctgtgtttgcaacaagggatgcaacatcaagcaaatatagctctttgtttttcagtttgtttggaacatcaccttcagcaatttttaaagcgagcccttcagcgatggcagttttccctacacccggctcaccaataagaaccggattgtttttgttccggcggtttagaatttcgatcactcgcgccacttcatcatcacggccgatgacgggatcaatgagaccggctttagcaccgtttgtaatattttgagccagctcatcaagcagccctttttttccgctttgttttgctgcgctcttttctttcggctggaatgcctgttcaaacggaaatccgaaagattgaggacccatactcattgaaggtttacgggtcagttcgttatagcaagtttcacaaagaaccatctgtttatgaacggaatttatttgcatgttaaggcgaatcgtcgcctcgttttgatgacaatgttgacaacgcatttgccaaaacctccttaataatttgatcttctttgaccaatgaaagtgaataaaaaggtctattggatttgaccttctttgactattagtatacggcaaacttaacggctttcaaaccaatatgctcaaagcagactgaatatttgactatctttgaccaattggtttttaaaaaaggccggtttgtttgaccaactttgattaatagtatactctgaccatctttgactttcaagccttttgcacaacattttttaatttgttacaaagtaaaacatgttttcttcgtcttttcaaggaacttgtctcataggttataaaaaggcatctatggacaaaactgcggttcgttcggaggggagaaatggaacaatcaaaagggtctgcaagtcagcttgcttttgtgtatgtcggcacagtagtcggagctggatttgcgactggcagagaaattgttgagttttttctgaagttcggctggttcggtttattcggcattctcgtcagcggcggaatgtttacgtttctgggcgccaagctgatgatcatttcaaagcgaatcaatgccaagtcatatcaagaaatgaacatctttttgttcggggcggcggctgggcgaattatcaatgtatttatgctgtttgttctcctcggagttacatctgtcatgctttcaggagcaggggcgctttttgaggaacaattggggatgtccgctcagattgggatgcttattacaatcggtctgagcttaattgtgatgactagaggagtaaaaggcattttcggtgtcaatgtgtttgttgttccccttttaatcctcttttcaatgattgtagtggccgactcttttatattcagcgaatcacgaaacgcagctcagtgggtctggccgcatcgctgggattggctgttatcagccttttcttacggggctttgaatttatcgcttgcccaagcagttttggttccgctggcgaatgaaatgtcctcggagaaagtgatcaaaaaaggcgctttaatcggagggacgatgctgacgattgtgctgtccgcgagttttctgtctttgtcaactcttccggatgtatttttgtatgatataccgatggcacaagtggtttatctctttgcacgatctgtccatttgatttatttactcattattttcggagaagtgttcacatcagttatcggtaatctatatggattagaaaaacaagtgcaaagctttcttccagtgaaaagcaaatatatctttgcggccattatgatcacggcttatattacgagccaaatagggtacggcaggcttatttcaacgatttatcccttgtttggctatgtgagcctggccttcataggcgctttgctttgcaaaaaagctcctcggcggcgcagtttataaatatatataatgaaacgaaccgtcactatagagcgataattgatctaggaaccggggactgacttttttattgtcaagaaaaacatcattatggtaagatagcagaagtgaaaaaattgaagaaaatccgtgcgatatgcgggagaggttctagctacaccctctataaaaaactaaggacgagctgtatccttggatacggccttttttatgtttttctagagcaccttccgaaaaaaggtgtttttttgcgtgaattagctgtagcgatgtctctcgccggcgtttttattgcggagaaggagaggaatcatgaaaaaagaaaaagcaattgtcgtatttagcggcggccaagacagcacaacatgcttactgtgggccttaaaagaattcgaagaagtcgaaacggtgacttttcattataatcagcgacattcgcaggaaattgaagtggcaaaatccattgcggaaaagcttggtgtgaaaaatcatttgcttgatatgtcacttttaaatcagcttgcaccgaatgccctgactagaaatgatattgagatagaagtaaaagacggcgaactgccatccacattcgttccaggccgcaatttggtattcttatcctttgcgtctatcctggcttaccaaattggcgcgcgccacattattacaggagtttgcgagacagacttcagcggttatcctgactgccgtgacgaattcgtgaaatcttgcaatgtcacggtaaatctggcaatggagaagccgtttgtgatccacacgcctctcatgtggctcaataaggcggaaacgtggaagcttgcagatgagcttggcgcgctggattttgtgaaaaacaacacgctgacatgctataacggcatcatcgcagacggctgcggcgaatgtccggcatgtcaccttcgttcaaaaggttatgaagaatatatggtgatgaaaggagagcgtgcataaattgttatctcaaatttatccgcaggcccagcatccttattcgtttgaactgaataaggacatgcatatctcagccgctcattttatccctcgggaaagtgcgggagcgtgcagcagggttcacgggcatacgtataccgtaaatataaccgttgccggcgacgaacttgacgattcaggctttcttgtcaatttcagcgtactcaaaaaactggtgcacggaaactatgatcacacgctattaaatgatcatgaagatttttctcaggacgaccggtattcgctgccgacaactgaagtcgtggcgaaaacgatttatgacaacgtacaggcttatttagacactttggagaataagccgacctgtgtacaggtgtttgtccgtgaaacaccgacaagctactgtgtctaccgtccgaaaaagggtggtttgaatggctaaaggaattcctgtattagaaattttcggcccgacgattcaaggagaaggcatggtgatcggacagaaaacgatgttcgtccggacagccggctgcgattattcctgcagctggtgtgactccgctttcacttgggacgggtctgctaaaaaagatattcgctggatgacggcggaggagatttttgcggagcttaaggacattgggggagatgcgttttctcatgtgacgatctcaggcggcaacccggctctgttaaaacagctggatgcttttattgaactgctgaaggaaaataacatccgtgcagcgcttgaaactcaagggaccgtttatcaggattggtttacgctgattgatgacctgacaatttctccaaaaccgccaagctcaaaaatggtaacgaactttcaaaagcttgaccacattttaactttacttcaagagaatgatagacagcatgctgtcagcttgaaggttgtcatctttaatgatgaagatctggaatttgccaaaactgtgcacaagcggtatccgggaatcccgttttatttacaagtcggaaatgatgacgtgcatacgacagatgatcagtcactgattgcacatttgcttggaaaatatgaagcgcttgttgataaggtagctgtcgatgcggagctgaatctcgtcagagtgctcccgcagctgcacaccctgttatggggcaacaaacgcggagtataatagaaaggaagatgaacatgacgacaagaaaagaatcagaattagaaggtgtaacattgctaggcaatcaaggtacaaattatttgttcgaatatgcaccggacgtgctggaatccttcccgaataaacatgtaaaccgtgattactttgtaaaattcaattgcccggaattcacatctttatgtcctaaaacaggccagcctgactttgcgacaatctacatcagctacattcctgatgaaaaaatggttgaaagcaaatcattaaagctgtatctattcagcttcagaaaccatggtgacttccacgaggactgcatgaatatcatcatgaatgacttgattgaattaatggacccgcgctacattgaagtatggggcaaattcacgccaagaggcggaatttccattgacccgtacacaaactacggaaagcctggcacgaagtatgagaaaatggccgaataccgtatgatgaaccatgatttgtatccggagacaattgataatcgttaattattccgttgtgtgatacggagtgtaaaaggaagtggagtcacagtaaaatccgaacattcagcgttaattttcagcgaagtgtgaccggagtgtgacccgcactaagctcaataaaagtgggaaaagtcacacctgaaaatggctctactcatgggaattgtattaaaaagtgtgacctgaggtgcaacctgaactgtgacttttatgcagtgaaaaattgatagtacagaagcagattaaggcgtacaatttgtacgtcttttcttttttatccgaaagaaaatatgcctatctagagatcataggcattaaatattattatcaatatcttcatttattttttggctaagtttctgaaccttctctttaacatttgaaacagctcttttttgaatttcatcaaagttctcctgaatatagtcgatgacacttcttattagaacttcactttcaaaattgaatatctcatttatttctgactgttcttcatctgttaggtgatggtattgaagttgtttagcatttacttcagtagctacatcaatcctaacttagttgttctggttgtacaatttcatattcaccttctgtatacttttgctccgcataatggcttccccattgacagagctcctgcaagataggtttaagagattctccaagttcagtggatgaatattcaaccttcggcggtacttgattatacatctttctgctcacaagtccactggcttcaagctctctaagtgtttgaatcagcattttctgagttatatttgggataatgcgctttaactcactcgttctctttggtccattcattaaaaagtataatacaaggcctttccattttccgccaataacttcctttgtcacttcaaacccacagctaaattttttcatgtctaaagctctccattccacatttattactttttagttactatatcacaaaaaagtgggtacttccgataatgggcttactgaaggatactatatcttgtaagttgttcttcaagtacttaaaggtactagacataaaataaaataattctaaaggagtgttaagtatgggtaaatttgaaggtaaaatagcgcttgtaacgggtggaacaagtgggattggtcttgctacagcacaaaaatttgtaaacgaaggtgcatatgtttatatcacgggacgtagacaaaacgaacttgataaagctgttaaccaaattggcaagaacgtaaccggtgttcaaggtgatatttctaagcttgaagacttagacaaactatatgacattataaagcaggaaaaaggtaagttggacattctttttgctaatgcaggcatcggcaactttcttccattaggtgaaattactgaagagcaggttgatagaacgttcgacattaacgttaaaggaaccatctttactgttcaaaaagcgttatcactattcccggacaaagtaggttctattattgtaacgggctctactgctggatcaattggcaacccagcgtttagtgtatatggagcatctaaagcagcattaagagcactggttcgcaactggattcttgacctaaaaggtactgaaatccgtgtaaatgtggttagtccaggaggtattcttacacctgcctacgatgagctttttggtgatgcacttgaagaagtaatggaaaatagcagaaatactgttccagctggaaaagttgggacacctgaagaagtagcaaacgctgtatctttccttgcttcagacgaaagcagttacttgacgggtgttgaattgttcgtagatggcgggctagcacaggtataatttcactgcgcagagattacaaatagtccccaaaaaaggttaatggggatttacttgaagaagtcgtataaaaaagtcgttttccttaaaggacagggaattcgacttttttatgtttgaatttgattaacgttgtaaattcgcattttcctggggctaccactaaatgacctgtaaaaaagattacactgtgaataaatgtacttaaagtaacgggggctcttgacttttaataaaaaataatatccctgtccttgtattctaatacttttgaaaatatttaaaggaatccttatgtcctgaataaccacataggaaaatatgttgtaggttgctttctttttttgtggggcatcccacacaagctatcttgtgatctcacacctgaacgttttttatagactagtaccgcgacaagttatattacatatacataccaataaagtagacattaaaagtgaaagagaggatggaaatgtgtgaaaattcttttccttgagagtcatcccatgtggctctatggtttaccgaatgggtttagggaagcaggacataccgtaatgatttccggtcctgtaagtcgggaaaatatcactgaaatgatagacgaatttaaaccagatctaatagtatctatgggatggacaccagagcattcaagggaaaagcaggcctggattcgcaacgctactaaaaaggtgaatatccctctcgtttattgggctactgaagacccgctgcacactcaaaactttactatcccgttaattaaaaagatgaaaccagattttgttttcacggttacgccttctctgtgtaaaacttatgaaagcatggggattaaagcagctcacttagattttgcatttcacgaaagtatacatcaccagattaaaccattagcaaaatacagttgtgatatagcagtggtggctaatgcttaccctaattttcttgaagaacatccggaagtgttccgttcgtcctctttaaaaacgcttattcgtcctcttatacggaagggtattcgcattgatttttgggggagaaactgggaaaaaatgagtaaatatataggaagagaaattccccccaattggatccatggataccttgattatactgaagcatataaagtttacagttcagcaaaagtcgttatcggtttgcaaaactgtgaaagccaacttacgcaacgcacctatgagattcttggttccggggggtttttattgacatcggatacaccagcagttcgaggtaaattcaaatctggccgcgatctcatcgtttcttcctccccaaaagaaacattggaaaaggttaaatactatttgaatcatgatagcgagagaaaaaagattcagataaacggtaaaaaggctgtaaagaatgattcctatcggcatagagccgagagaatgcttgaggtgctaaaaagcagaggaattataagaaacttaggggaaaccattcattatgtagatgttctcaaagaaaaatacctgatccatcatgttactcccggtgaaacattatcaataattgccaggaagtataatgtttccctgcagcaactcatggagcttaatcatttcaaatcagatcaaatatatgctggacaaatcattaagattagagagaaactgtttagaaatattaataacaaatttttctaaaggagagtaatatgaatgaaggagagaataccaaaaaaggaaatagagcgaataaagtaaaaagaacgcctcgttatatggaatttcccgtgacatacgaagtatataatgtggaatccggcgatacattatggacgattgccaaatcctttaaaattccggtacaacaacttatgaatcttaataagctttcttcagatagaatttatcctggacaaattataaagataagagaaagataatctttgaggtttcggaaacgaatcaaattgaaatgacaatccttatttttttatttgtggggaacttgatatttttggggatgaaggggttatgagatgtttcaaatgagctatttctattctggattaggatgggattttattcaacacgttgatcaaacgaacggagtattaaatgttgtgtctcctgattttttctatatcagaaaagatggatcattacttctccgttcagctaatcccgatgtgattaaagctcttcatagaagaaaattaaaagtagttccttttctaagcaatcattgggatcaggatttgggacgatttgcattaatgaaccgagttcgtttagctaaacaaatttctcatgcaatagaagaactggatttggacggaattaatatcgatatagaaaaccttacagaaaaagatcggaatctatttacagattttattagattagtaaggaaaagtattcctaaacataaagaagtatcagttgcagtggcggcaaatccttttggctggacgaagggctggcacggatcatatgattacgagtatttagctaaatatgcagattatcttatggttatggcctatgatgaaagccgccttgctgggcctaccgcaagtgtaggatgggtggaaaagtccattcaatatgttctgacccaaaaaatctctcctcaaaaactagttttaggattgccattctatggccgctgctggatggaaggccaatctgcctctcaagccattcccctttaccttgttgactccttagtaaaaaggcatagcgggacaattatttttgacaccaagagtcaatctccaaaagctatttttactgtcaatcacgataacaaggggccgttgccttcgggaacatatacattatggtttgaaaatgaacagtcactcagagcaaaaataaaactcgctcaaaaatataatctgaaaggtcttggcagctggagtcttggacaagaagatgtgtcagtctggaatacagtgtttaaaaatatataatgatttatagttcagaacaaaattcgaagataattgcaatgaatctctaaatggacatactgaaaggagtttattacgagtgcgggtaaaacagtgagggcattccataggcccttctcccgaaatgttctatacgaggcattacattgggcttgaaatacacattcaaacttatgttatagtacgcatttcaagtaattacggatgtgttgaatttattctgcttccatgatttaagtcatacacatgctacttgatagcaggattattgcatttcattcagaattgttcaggatcgatatggaagcgcacgaataactagaactttaaaagcatacactcatatacttcctgaatggatgctggtttatctaaaaaacatgatgagaattgattgaccgctctcattaaaggatggagaaattcaaggcgccaaggtacgcatggtgaaacatgacttgttgataatcgaccatatagtttctccttagaaatgagggggtttttacataaaaaagacgagcgaatccggggggaattccactcgccgctttctaatgaaaagacgggatgctggatggcagctcgtctgttttattataatttaacgaacgtatgtttgtaaaggtgtcttttcgaatgaattggttcatataaccgttaagaacagattcattgtaaacattcgctaaggtatgctaagatgcatggactataaaggagtgatatgaagtgaagacattgcggttaaacaatgtaacgttagaaatggctgcatatcaagaggagagcgagccgaagcgaaaaattgcatttaccttaaacgttacgagtgagacttaccatgatatcgctgtcctgttgtatgaaaaaacgtttaatgtcgaggttccggaacgcgatcttgccttccggggggaaatgacaaattattcaacatcattgaccaacctgtacgaaccaggggccgtcagcgagttctatatagaaataacagaaatagacaaaaacgccgattcatgatcggtgttttttatgtaaaaaagctgccggccggcagcttttgagaaagcgaatttcatatgtaaggtgttaaattgtccgtcttgcagttttttgaataaatgtggaaataaggaggttttaataggagtctctgatgatcttataatttttatgattaacaactgtcaatgaatctaactcaagatcccgatagttatccatgatcgtcacatcaacgataacagaattctcatttactttttcaacaacaccggttaatccgtttttaaattcaatgacattcccaaccttagcgattttcacaagcttcctctcctttaaacataataatgccttttgaaagtattttgcagtattttcattgagaagtaaagcgataaggagttttatctcccttatgaattgtcctgtcgctataaagatgatatattgattttcgtcaatagaaagaaaaggggggaatttttgttgcgtcccgaagaaataacagaaatgattgaacagctgcgcaccggcgccataaacgaactgagagtccagaaagagcattttcttgatttcagggccgtgttatctaaacaagatgattttaaacatttccgaggaattgcccagcaaggcggagatgttatctttcaatacttagaacagccaagaagctgaaggtttctcatacgtgagaagcctttttatcatatatgacagaacacaagccttttattacagctgtctgtaacaggtgtaataaaatgtaaagtgtcaaaaatggataaacatgttttaatttgacaatatttatagaatttcaaactgtttttttgccattaagcagtgagtcatcctctttattccatcctgatacctccttgggagagttggaaaatctttttccgtgaaaatgaatggatctcttgttaaggttatgaagtgttttttggagcactttaaggaggaaactgtatgacaacgaaattcactgctctggctgtttttcttctttgtttcatgcctgcagccaaaattgagcatacacaagcttcactactgagcgcaaagaagacaaaacatgaagaagcgaaatggcttacacatatagatcgaaatacgaatgaatctttcccttcactgtctgctgataaagacaagaaaataaaaccgattaagctatcagcacacactgaaaagaaagagaaagataaaccggacaaaacaaatgatgagaaagaaacatatacacagtctgaaaaagagttgctgtcacgtctcgttcacgcagaggccaaaggagaatcatataaaggcaaggtcgctgtagcaagcgttgtactgaacagaacggagaaaaaaggttttcctgatacgataagaggagttatttatcagaaaaacgcctttgaaccggtcgcaaacgggagcattaaccaaaagcctgataaagaatcgattgaagctgccgaagaagcgctgtcctcaaaaaatagagaaacagatgccatattcttttataatccgaaaacagcgtcagataattggattcgttcaagaaaaatcgtagaaaaaatcggcagacacgtttttgccgtctaagcatagaagagacaatttgtctcagctgtgcttttttcatataaagagtaaaaataaaataatttttgaacttgtctcatatgatgttggtagtacaagagacaaggagagacatcatgaatcgatttgtgaaagggatcattcttttatccattgccgcctttttcgctgaatgccttgaatttgtcgtcaatatgattttggcgcgggagcttggcgagcatgggatggggctttacatgagtattttgcccacgatctttttaattattgtcatcgcgagcctggaactgccgatatccatttctaaattcattgccgagtcaaatcctaagcttcatgaaagcatgctgaggcacgctttcagaatgacagccatttttactgctttttctactgtcgccgctagtattgcgcttccgtttataccggtatttgatacataccacccgtttattaaagggattgtcatcggcttaattcctgttgtcgcctttacttcaatcgccaggggctactttatgggtgtgcagaaaatggggaagatcgcaattgccaatgtgctgaaaaaaatcatccagctcttgtgcttattcctcttttttcaatggtactcatttgaattggacatggctgtgctgatttccttgtttgttctagtcgtgagtgatgtggtcgtgcttgtttatttatattcacaatttatcatggcaaggcgggcgttatccggccagcagcacattcatttgcgcggaaaggatgtaaggaaaagactgcttgctgtttcaattcctacaacaggactgcgtatttttcatgcggttgtcaatgcaattgaaccctttttagtaaaaggagctcttttggctgcgggcgttgccgggacagcggcgatcgatcaatacggaatgctggcaggagtggctgtgacgatagggtcgttccctgcttttattgcccattcgttaatggtcgtcatgataccgagtatttcggaagcttatgcactttctcagtatgacatcgtgttaaaaaggctgaagcagtcgattttcattacattaggttacggtatacctgccgtctgggtcatgttccagtttgcgggacctctcacgcatttgttttttcactctcctgaagcgcagtattatttgcagctgttgtggccttactttctctttcatctgtttgtcatgccgctgcaggcgtgcttaatcgggatgggttttgtgaaagaggctttttatcacaatgtatggagtcatatcgttgcgctaagtatgatgtatgtactgggatcaatggagaatctgcaaatgctcgggattatccttggaatgaacactggcatgattcttttgacgagcctgcactatgccacgatctgcaaagcattgaaggtatccgtattccttacgggagggaccagaacgccgcgaattgaaggatgatataggaactgcaggggcaagctaattgaaaagcatgaaaggaagattccatgttgacgaagcgcttgcttactatatacattatgttattagggttgattgcatggtttccatgtgcggcacaagctgaggaaaaacagcctgctgttcccgctgtttttcttatgaaaacgatagaaggggaggacatctcgattccgaataaagggcaaaaaacaattctccatttttggacgtcatggtgtccgccctgcaaaaaggagcttccccagtttcaatcgttttatgatgcccatccatccgacagtgtaaagctggtaacggtgaatttagtgaattcggaacaaaatcaacaagtcgttgaagattttattaaagcaaacaagctgacgttcccgattgttcttgactcaaaaggggaattgatgaaggagtatcatatcattacgatcccaacatcatttttgctgaatgaaaagggagaaattgaaaaaacaaaaattggcccgatgacagcggaacaactgaaggaatggacggaagaatagctgagagcatagactctcagcttttttcatatagagaagaagcgaataaacattaatgataattattatcaaaaagaaattaaaataattataattgaaattctcttcgtgcgtgctataataaaggaagacatcaagaaataactgacgataaagctgccttttgggcagcgattttgtttttataagagaaatgaagatgatttacgttctcaattagagaggagaattcgatatgaatgaacaagttatcgttcaacgcgacccgcatgagccattgaaaacagacaagagggaaaaaaactgggcacagcacgcggagcttattgcagcacttgtatcaggcgctcttattttggcaggctggctcttatccggatatcaggtattatccataatacttttcttgctggcttttgtgatcggcggatttgctaaagcgaaggaaggaatcgaagaaacactcgaagccaaaacgctgaatgtagaacttttaatgattttcgctgccgttggttccgccttgatcggatactgggcagagggtgctattttaatatttattttttccttaagcggagctttagaaacatacacgatgaataaaagcagcagagatttaacgtctttaatgcagcttgagcctgaagaagcgacattgatggtcaatggtgaaaccaaaagagttccggtttcagacttgcaggccggtgatatgattgtgatcaaacctggagaacgcgtagcggcagacggtatcattgaatcgggctcgacaagtcttgacgagtcggctttaacaggtgaatcaatgcctgtagaaaaaaacacaggcgacactgtattcacaggaacggtgaatcgcaatggctccttgactgtccgtgtcacgaaagcaaatgaagattcgttattcagaaaaattatcaaactggttgaatcagcgcaaaatagtgtttcacccgctcaggcttttatcgaacgatttgaaaatgcttatgtgaaaggtgtgctaattgcggtggcgctccttttattcgtcccgcactttgcgctgggctggagctggagtgaaaccttctaccgcgcaatggtgtttatggttgtcgcgtcaccttgtgcgcttgtcgcctctattatgccagcggcgctgtccctgatttcaaatggcgcccgcaacggtatgcttgtgaaaggaagcgtctttcttgaacagctgggctcagtgcaaatgatcgcctttgataaaaccggcactgtaacaaaaggccagcctgccgtagagacgatcagaatagcagaaggattcagtgaagcggaagttcttgaggctgtctatgccatcgaaacgcaatcaagccatccgctcgcccaagccataacggcgtacgctgacagccgtggcgtgaatcagtccggctacatatctatagaagaaacctcagggtttggcgttatggcagaagtgtcgggtgcgatatggaaggtcggtaaagcaggttttatcggcgaggaaatggcagcacaatttttgaaacaaacagcatccgatgtcattcaaagcggtcatacaattgtatttgtgaaaaaggatgatcaaatagtatgctgtatcgcactgaaggaccaaatcaggcctgaagcaaaagaggtcatggaagaactgaaccgacttgggattaaaacggccatgctgacaggagatcacgaagacacggctcaagcgattgccaaggaagccggcatgacaactgtcgtagcagaatgcctgcctgaccaaaaagtgaatgaaatcaaacggttaaaagaagaattcggaacgattgcaatggtgggtgacggaatcaatgatgcgccggcactcaaagcggcggatgtcggcattgcgatgggcggcggaacagatgtagcacttgagaccgctgatatggtcctcatgaaaaacgatttgaaaaagctcgtaaacatgtgccgcttgtctcggaaaatgaacaggatcatcaaacaaaatatcgtgttttctctagctgtaatctgcctgctgatttgtgcaaactttttgcaggcgatggaattgccatttggcgtgattggtcatgagggcagcacgattttagtcatactaaacggtttaagactcctaaaataaagccagcagcctaatcaggctgctggctttttatgtatcaagctttcccttcatttttgtctttatcagatcttttcataaccaggatgagagcgaggatgcagcaaaggaaacccgctgcacagcctatgatagagctgtaataataaaagcccaccatcttcatcccgataaaaggagcggaaattcccaaaaccgttaagagcataactgcttttcgtctgaaaaaattcatcagcaaacggaacaaccccctgcgattgaacgttactgtcagtatacaggaagaggagcaggaaataaaatgcattagaaaatgaaggcgtcgtgaaaggcaaacaccggtaaaacctgttacaatggaagacagaacaatgcattgcaaatggcagggaggaacaagaagtgaatagaatacaacgcgtctcttcatggctgaaggaagcggggcatactgccgcatttattcatacaaaagaaaatgttttttacttaaccggtttttacacagagccgcatgaaagattaatggggttatttatttttcaagaagaggagcctttctttgtttgtccaggaatggaagcaggacaggcccgcaacgcaggctggaatcatgaaatcattggctatgcggatcacgaaaatccatgggagctgatagagaaggccttgaaaaagcgaaatatcagcatacatacgcttgcggtagaaaaggattcaatctcgctatcacgtgcagaacagctgaagcatgcgacgggcggggctcaatttgtttcagcagaagaaacactcaatcaatttcgcctgattaaagaagacaatgagattcgtttgctgaaagaggcggcaaagcttgcggattacggtgttgaagtcggcacagccgctttgcgtgaaggcatcagtgaagtggaagtgctcgctcaaattgagtatgagctgaagaaaaaaggaattcagggcatgtctttctctacaatggttttattcggagaaaaatcaggccagcctcatggaaatcctggtacagccacgttgaagaaaggtgattttgttttatttgatctcggtgttattcttgacggctattgctctgatattacaagaacgtttgcatacaaaaccatcaatccgaagcaggaggccatttacgagactgtgcttcaagcggaaaaagccgcgattgaggcaagcaaacccggtgtgagaatcggagatctggatttaacagcccgtggaatcattgaaaaagcgggatacggtgactattttcctcaccggcttgggcatggactcggaatttctgtccatgagtatccatccatgagccaggccaacgatacactgttgcaggaaggcatggtctacacgatcgaaccggggatttatgtgcctgagatcggcggcgtgcgcattgaggatgacgttcacgtaacaaaggacggagcagttgctctgacccaatatccaaaggaattaatcatactgccgtaatagaaataaaaaaggactttgttctcgacatcgtccttttttatctgcattaaataaaaaaatcatcaaatgttcgaaagggtttaatttcatgtttttggttgagaggttttacagcaagacagctgccaccgagaacagtgagacataacccaattaaaatgaagaaacccatgtgatcttctcctttcagcttaaaacacaaaaagatatctggtacgtccatatcatattgtatgaaacgcattccagatcaaggggatttagaaagaagggaatctatggctaatattaaagacattgcagaaaaagccggtgtctctgttacaacggtttcccgagtcataaacaatcatccatacgtcagtgaagacaaacgaaaaagagtgtttgaggcaatggaatcattggagtacacgagaaatattcacgctgtacatttgtcgaaaggattttcaaacatgattggtgttgtcttgccaacggttaatctgccatattttgcagagctgattgcaggaatagccgacgcagccgcggaatccggggttcacctctctttattccaaacaaactatgaggtacaaaaagaaatctttgcgctgtcccaattaaagcagcgccaggttgacggcctgattttttgctcaaaggcgcttgctgatgagaaactcatggaatgggagggcccgattttgctttgccagaattcagataatgcccgcttcccaaccatcagcattcctcaccaagaagcatttcggaacggcttggactatttaattgccaaagggcacaaaaaaatagccatctgtttggcaagaaaaaaaggcatgaacagccattttcgaatcaaagcctacaaagaggcattggaagagatcggcgaggcatttcgtgaagactgggtaattgagaaagcgattacaattaatgatgggaaggcgctttttcataaatggaaaacgtggaaggaaaagccgacggctatttttgttgccaatgaccaagtctcagcagggctttttcttgaagcaaagaaccagcgggtgtcagtaccggatgagcttgcaatcttaagcgttgataaccacgaaatcagccaagcgcttggaatcacaacgatcgatattcagacaagggaaatgggaaagcaggcatttgccatactggaaaaaagaattcaaggacagccaattgaaaggaaagttctggattaccgtctcatcgaaagatcgactgtttagtgaatgcattgaaaaaaggtttgacgtgcattccgttcgttatgtacgatatgaggtattgaatgacaaaggagctgaggatcgtgaatgggtccttcacagtgaaaaaggtactgaataataacgtattaattgcttctcatcataaatacagcgaagtcgttttaatcggaaaaggtattggtttcggaaaaaaacaagatgatgtcattgaagataaaggctacgataaaatgttcattttaaaagacgagaaggaacaaaagcaatttaaaaagctccttgactatgttgatgaaaagctcgttgatatttcaaacgatgtcatctatcacataagaaataggactaatcactcattaaatgaacatattcacattgcgttgacagaccatatcgcatttgcgatcaaaaggcagcagcagggatttgatatgaaaaatccatttctaatggagactcagtcactatatcctgaggagtaccaaattgccaaagaagtcatagatatgatcaatgaaaaagcgggaatctgccttccggaaggggagattggttttatcgctctgcatatccattcagcattgacaaaccgtccgctgtccgaggtcaatcagcactctcagctcatggcgcagcttgtcgaggtgattgaagactcatttcaaatgaaagtaaataaggaaagtgtcaactatttgcggctgatcaggcatatcagatttacaatagaaagaattaaaaaagaagaaccgactaaagaaccagaaaaattaatgttgttattgaaaaatgaatatccgctatgctacaatacagcttggaaattgattaaaatcttgcagcaaacattgaagaaaccagttcatgaggcggaagcggtttatctgacgcttcatctgtaccgattaaccaataaaatttcataaattcagtttatccttataacgtgttactgattcgatcaggcatgagtgattgagggaaaaaaacgggaagttcattctcgttcttttgcgcacccaattttgctcatgcctttttgttgtgtaaaagggcaaatgtaaacggttaaactggaagacttacgcctgtgaattcgttgtcatgatttttagctgtaaggtcagactagtaaaaagaggaggtcaattcttatgtttaaagcattattcggcgttcttcaaaaaattgggcgtgcgcttatgcttccagttgcgatccttccggctgcgggtattttgcttgcgatcgggaatgcgatgcaaaataaggacatgattcaggtcctgcatttcttgagcaatgacaatgttcagcttgtagcaggtgtgatggaaagcgctgggcagattgttttcgataaccttccgcttcttttcgcagtaggtgtagccatcgggcttgccaatggtgatggagttgcagggattgcagcaattatcggttatcttgtaatgaatgtatccatgagtgcggttcttcttgcaaacggaaccattccttcggattcagttgaaagagccaagttctttacggaaaaccatcctgcatatgtaaacatgcttggtatacctaccttggcgacaggggtgttcggcggtattatcgtcggtgtgttagctgcattattgtttaacagattttacacaattgaactgccgcaataccttggtttctttgcgggtaaacgtttcgttccaattgttacgtcaatttctgcactgattctgggtcttattatgttagtgatctggcctccgatccagcatggattgaatgccttttcaacaggattagtggaagcgaatccaacccttgctgcatttatcttcggggtgattgaacgttcgcttatcccattcggattgcaccacattttctattcgccgttctggtatgaattcttcagctataagagtgcagcaggagaaatcatccgcggggatcagcgtatctttatggcgcagattaaagacggcgtacagttaacggcaggtacgtttatgacaggtaaatatccatttatgatgttcggtctgcctgctgcggcgcttgccatttatcatgaagcaaaaccgcaaaacaaaaaactcgttgcaggtattatgggttcagcggccttgacatccttcttaacggggatcacagagccattggaattttctttcttattcgttgctccagtcctgtttgcgattcactgtttgtttgcgggactttcattcatggtcatgcagctgttgaatgttaagattggtatgacattctccggtggtttaattgactacttcctattcggtattttaccgaaccggacggcatggtggcttgtcatccctgtcggcttagggttagcggtcatttactacttcggattccgatttgccatccgcaaatttaatctgaaaacacctggacgcgaggatgctgcggaagaaacagcagcacctgggaaaacaggtgaagcaggggatcttccttatgagattctgcaggcaatgggtgaccaggaaaacatcaaacaccttgatgcttgtatcactcgtctgcgtgtgactgtaaacgatcagaaaaaggttgataaagaccgtctgaaacagcttggcgcttccggagtgctggaagtcggcaacaacattcaggctattttcggaccgcgttctgacgggttaaaaacacaaatgcaagacattattgcgggacgcaagcctagacctgaaccgaaaacatctgctcaagaggaagtaggccagcaggttgaggaagtgattgcagaaccgctgcaaaatgaaatcggcgaggaagttttcgtttctccgattaccggggaaattcacccgattacggatgttcctgaccaagtcttctcagggaaaatgatgggtgacggttttgcgattctcccttctgaaggaattgtcgtatcaccggttcgcggaaaaattctaaatgtgttcccgacgaaacatgcgatcggcctgcaatccgacggcggaagagaaattttaatccactttggtattgataccgtcagcctgaagggcgaaggatttacgtctttcgtatcagaaggagaccgtgttgagcctggacaaaaacttcttgaagttgatctggatgcagtcaaaccgaatgtaccatctctcatgacaccgattgtatttacaaaccttgctgaaggagaaacagtcagcattaaagcaagcggttcagtcaacagagaacaagaagatattgtgaagattgaaaaataagggtgttagtacgccgtgcttgtcagatgacaagtacggttgtatgatataatattgtgaagtaataaagctttaagttaaaaggagaatgataaaaatggcacaaaaaacatttaaagtaactgcagattctggaatccatgctcgtcctgcgacagttcttgtacaaactgctagcaaatacgacgctgacgttaatttagaatataacggcaaaacagttaaccttaaatctattatgggtgttatgtctttaggtatcgctaaaggcgctgagatcacaatctctgcttccggagctgacgaaaacgatgctcttaacgctttagaagaaacaatgaaaagcgaaggactcggcgagtaatgcaagaattaaaagggattggtgcttcagccggcatcgcgattgcaaaagcataccggcttgaagagccagatttaacggttgaaaagaaaaacatctctgattctgaagcggaagtaagccgttttgatgaagcgattgcacgttcaaaaaaagagctcgaaaaaatcaaagagcacgctttgaaagaactgggtcaggataaagctgatattttttctgctcaccttttagttctcagtgaccctgagcttctgaaccctgtgaaagaaaaaatcagcactgattcagtgaacgctgaattcgctttaaaagaaacgtcttctatgttcgttaccatgtttgaatctatggacaacgaatatatgaaagagcgtgcggcagatatccgcgatgtaacaaaacgcgtaaccggccacctgcttggcgtcgaaattccaaacccaagcatgatctcagaagaggttattattgtagctgaagacttaacaccgtctgacacagctcaattaaaccgtgagttcgtaaaaggattcactactgatatcggcggacgcacatctcactctgccatcatggcacgttctcttgagattccagcagttgttggaacgaaagcggcgacaggcacgatccaaaacggcgtgactgttatcgttgacggtatcaatggcgatgtcattattgacccatctgcggaaactgtaaaagagtatgaagaaaaacataatgcttatttggctcaaaaagctgagtgggcgaagcttgtcaatgaaccgactgtctcaaaagacggacatcatgtagagcttgcagcgaacatcggtactcctgatgatgtaaaaggtgttcttgaaaacggcggagaagcagttggcctttaccgtacagaattcctttacatgggaagagatcagctgcctacagaagatgagcagtttgatgcttacaaaacggttcttgagcgtatggaaggaaaatcagtcgtcgtgcggacacttgatatcggcggagacaaagagcttccttacctgcagcttcctaaagaaatgaacccgttcctgggatatagagcgattcgtctttgccttgaagagcaagaaatcttcagaacacagcttcgcgcgctgcttcgtgcaagtacatacggaaacttgaaaatcatgttccctatgattgcgacagttaacgaattcaaagaagcaaaagcgatccttcttgaagagaaagaaaagctcgtaaaagcgggacaggctgtatctgacgatattgaagtcggaatgatggttgagattccgtcaactgcagtcatcgctgatcagtttgctaaagaggttgatttcttcagtatcggaacaaacgatttgatccaatacacaatggcagctgaccgtatgaatgaacgtgtatcttacctgtatcagccatacaacccggcaatccttcgcttaattacactcgtaattgaagcagcacacaaagaaggaaaatgggttggcatgtgcggagaaatggcaggagacgagattgcgattccgatccttctcggcttaggcttagatgagttctcaatgagcgcaacgtctatccttccggcaagaacacaaatcagcaaattgtctaaacaagaagctgagtcattcaaagagaaaatcttatctatgagcacgacagaagaagttgtcgcgttcgtaaaagaaaccttcaagtaatgtacaaaaaccagacggcctccggcctgtctggtttttttcataagtaagggcatagaaggacacaataacatggctaggagggatagtatgtcaaaccaatttaacgcaggagatactgtttatgtgatctacagaaatccgcacgctgccaatgtagctcacataaaggaagccgaaattgtgcaccatccataccatgaaggcgagctttccctgtttatttatgaaacctatcatccgttcgcagaggacgatgctgtgtttgcaagctatgaagaagctaaatcgctttacaaagaactgtttgatattgatccgtatgagtaacaaggaaatcattacaactcatatcctttccgcctagtgagaaaagtaacgttagtaaaggaaaaggatgtggcatcatgcagaacccatttgttccgcagcttgtgtatatagaaccgagggcgctggaatatccgctgggccaagaattacaagataaatttgagaatatgggtattgaaatcagagaaacgacatcccacaatcaggtgcgtaatatccctgggaaaaatcatcttcagcaatatcgcaatgcgaaatcaactttagttatcggtgtccggaaaacattaaagtttgattcatccaaaccctcggccgaatatgccattccgtttgcaacaggctgcatggggcattgtcattactgctacctgcaaacaaccatgggatcaaagccgtatatcagaacttatgtaaacgtcgaagagattttagatcaggcagataagtatatgaaggagcgcgcaccagagttcacaaggttcgaagcatcatgtacgtcagacattgtaggaattgatcatctgacacacacgctgaagcgcgccattgaacattttggccaaagtgatctcggaaagctccgatttgtaacgaaatttcatcatgtcgatcacctattagacgcaaagcataacgggaaaacgagattcagattcagtattaatgccgactatgtgattaaaaactttgagccgggaacttcacctcttgataagcggatagaagcggcagtaaaagttgcaaaagcaggctacccgctaggctttattgttgctccgatttatattcatgaaggctgggaagaaggatacagacatctgtttgaaaagctagatgctgctttgccgcaggacgttagacatgacattacgtttgaattaattcaacaccgttttacaaaaccggccaaacgagtgatagagaaaaattatccgaagacgaagctcgaattagatgaagaaaagcgccgttataaatggggccgttacgggatcggaaaatatatttatcagaaagatgaagagcatgcacttcgagaggcacttgaatcctatattgatacctttttccctaacgcaaaaattgaatatttcacttaaacgggctgttgtgatcaacagctcgcttttttataaaaaggatttttccattccatcaaaacgccgtaattcaatgattctttatcctccaaataattgctgactacacgaataggtgaacgcccgcaacggaggagaaaggacagcacagggtcgtttttcctgccttccatcacatcttcaacgtactgaacagcgctgatctcgtgtgcgtatttataatacaaaggaatgcggccgccgccgagaaggcgttccagtcttttatcaacagtcagctcatacatcgtattcatcagccattttccgattccaagctttcgataatgaggagaaacagaaatatccactacatataaagtatttccatgaggttcatgatttttaatcgatccgttgtcagttgcttgtgcccatgtatgatcaggagattcaggctcaaattgtacaataagagcagtcatggaaccgataattctgtcattgatgagcgcgcataaagcgccttccggaaaggttttgatatggctggcaagctggtcctctgaccacagcaattcctggggaaacggaggagggaaacattcttcttgaagagaaatcagcctctcgatgtcagtctcagtgtagtttctaatggtcagagcctcaaattttctgccgtcatgcacatacatttgttttagtatgatcatcactctccttatgttgtttcattataacgaagattgaattttcagtaaatatattccgattttcttataatttattttttgattattcatttttcaaacgaaagggccgatatagaaattaggaggggattggtttgtttaaaaaacttcacatgaagattgctgtttttgtttcgattatgttaatcatcacagttgttcttttaatgctgtcttcttatttgacgctaaaaccgatgattacagaggatgggaaaaatacaactcaaaacgtgacgcagtcacttgaacaaaatattgaattgcaattaaagagttatgccatttcgttatcaagattggctaatggggaattaacgcatacatttgtaacgaaaccaagtaaagaagcttctcggctgtttcacgatgacattaagcaaatcaaagataacgatgattatgttgcgatggcttacataggcaccgcaaaaaaagaaatgtttacatatccaaaagcggatttcgctgaggattacgatccaacatcaagaccatggtataagcttgcagctgaaaccccggatcaagttgtttggacggaaccttataaagatgtcgtgacaggagacatgattgttactgcatcgaaagcgatcttagacgggcaaaaagtgataggggttgccagctatgacttgaaactctctgctatccagagtatggtcaataaacaaaaggtgccttacaatggatttgcctttttagctgatgcgagcggcaatcttttagcccatccgtcaaatcaaggaaaaaatatatcaaaggatcaaacactgcaaaccatcgcatccgagaaaaaagggatacaagatgtgaatgggaaaatggttgtgtaccaaacgattggcgaaacgggctggaaggtcggaacgcagtttgataccgatcaattaatgtggatttcagataaaatgaatcgggcaaatctttggatatcattgattgcgcttatcataacaattattctcagctacttcctggccaaaacgataaccggcccgatacagcagctgatcgcaaaaacgaaagctgtttccgcaggcgatttaacagtgcgcgcggaatcaaaatccaaggatgaagtcggtattttaacaagagactttaatctgatggttgaaaatatgaaggaaatggttgagcaagtcagactctcttcagggaaagtatctgacacctctgaacaattaacggctgtctctgccgaaacaaatgaaacaagcggacaaattgcaaaagcgattgaagaagtagccgcaggggcatcggaacaggcttctgaagttgaaaccattaatgaaaaatcggaaagcctgtcaacgaaaatcaggcaaatcgctgaggaggcaggcggaattaaagaacgatcaaaatcgtccgaggatgcaagctataaaggacttgacgcgctcggccagctgctgatgaaatcaaacgaagccaatatggaaacgaaaaaggttgaaacgatgctgctggatttggaaaatcaaactaagaatattgaagaagtcgttacagcgatttcaaacatatctgatcaaaccaacttgcttgccttaaatgccagtattgaggcagccagagccggagaaagcgggcgcggttttgccgtcgtagccgatgaagtgcggaagttagctgagcaatcagccctttctacaaagcatatcagcgagactgtgaagcttatccagcttgagacaaaagaggcctctcacgcgatggttgaggcaagcagaatgaatgatgaacaaaacagtgccattcacgaaactggagaggtattaaatacgataactgcagaaatgcagtcactggtacaaggtattgatcacatttacgcggaaattcaaagaatgagtgaagaacagcttgcgatatctgaagctattcaaagcatttcagccatatcacaggaatcagctgccgcagcagaggaagtgaacgcatcaaccgatgaacagcttgtcacccttgagaaagtcaaacactcaacggaaacactaaaacatgcaagccaagagcttatgaacacaattgcaaaattcacattgtaatccaattacatccccaaacatcatttgttttggggattttttattttataagatgaatagatatggtagtctagaaaatgaaggaaaaatgataaattttaactaaaatctaaacgaaacatctgggaggaatgaccttgaaaaaaacaattggttttatcggtcttggagtaatgggaaaaagcatggcatcacatattctcaatgacggccaccctgttttggtgtacacccggacaaaagaaaaagcagaaagcatacttcaaaaaggcgcgatctggaaagatacggtcaaagatctttcgaaagaagcggatgttatcatcacaatggtcggctatcccagtgatgttgaagaagtgtatttcggaagcaatggaattattgaaaacgcaaaagaaggcgcatatcttattgatatgacgacatctaagccttcgcttgcgaagaagattgctgaagcggccaaagaaaaagcattgttcgctttagacgctcctgtttccggtggagacgtcggtgcacaaaacggaacactcgcaattatggtcggtggagaaaaagaagcttttgaagcctgcatgccgattttctctttaatgggagagaatattcagtatcaaggaccggctggaagcggacagcataccaagatgtgcaatcagattgcaattgcagccggtatgatcggtgttgctgaagcgatggcttatgcccaaaaatcaggcctagagccggaaaatgttctgaaaagcatcacaacgggcgcagccggaagctggtcattgtcaaatcttgctccccgtatgctgcaaggcaactttgaaccgggattttatgtgaagcattttattaaggatatgggaatcgcactagaggaagcagaattaatgggggaagaaatgccaggcttgtcgctcgcaaaatccttatatgacaagctagctgctcaaggtgaagaaaacagcggaacacagagtatctataagctttgggtgaaataaaaaaagattgcctgtacgaaacaggcaatcttttttttattattttccgatgaattgttgtgtccagatgcttccagactcaacgtagccaacaccgatgtgagtaaagttagggtttagaatgttttttctgtgtccttcactgttcatccaagcttttactacttcttctggtgtcttttggcccttcgcaatgttttcacctgctgttttgtagctgattccgaaagatttcatcatatcaaacggtgagccgtatgttgggctttggtgatcaaagtagtttttgtctttcatatcctgagattttgcgcgtgcggatttgcttaacgtttcatcaatttgaagcggctttaatccttgtttttgtctttctgcatttgtaagttcaacaacttttttctcatatgcacttacagatgaaggtgcagatgttgttgtgtttgttttttcagcagttgcaggtgctttagaagcagtgttttgatcagcagctgctttttcagtagtcttttgtgcaggttttgccgtttctgtcttttgaacatcctgaactttcacgttagattgcttcgcatgtttttgaagaagctgcttcatctctttttcgtttgcagcgtttaacgttttgatatttgtgttaatatgcagctttttcactgcatcgttaagtgacatgttttgtactgtgttccccgtttttactgtaaccacaggctggcaggagagttctttcgctgatgcttgctgtacgcccccgaatgtgaataatccaaccgcagcggcagcagataaaataaatgctttcttcattagttcgtaacctcctagagttgtttgtttctacagaaaaatcataacatagcttttttgtcataaagattccagcactttcctttgacaaatagagattgtcattttcgtaaagtaaatccgttgaatcactaagaataagggaatcagcggtatatatgattttatcgtaccgttacatagcttccttttttttgaaccgttagttatattttaatgtgtttttatattgacagcttttttttactccttttcgctgtaacaactattacaaaggtgttacaattaatctcagtatatgtaaatatattgaacgatttgagaggggtaaccagaagtgactgaaataggacgtgaaccaaagaaaaagagcaaaggaaacagagcaatcagaatgaacctttttttcctagctgtctttgttctattcactgcattaatttttaagctcggggttgttcaaattgttgaaggcgaacagcatgaagaagacgctgagaaatcaaatgcaaaaacagcttactatcctgcgcctcgcgggaagatgtacgacagaaaccagaaagttgctgtcgacaaccagagcgttccagaaattgtgtatgtatcaacatctagcacaaaaacagaagataaaatcaaaacagcgaagcggcttgcttctttcattcatattgataccgaatttttgaaggaaagggatctttgtgattactggatcgcagctcatccgaaaaaagccgccgctctgcttaaggaatcagaaagcaatctgaaaggagaccaagcttacaagcttcaaatagagcgtgttccggatcaagaattaaaggctattcagcaagatgacgaagaaatggaaactgctgcgatatatacaaggttttcaagcggaaatgcttacgaacctcaaatcgtaaaggcaatgaatccaaataagagcaatagcaatggaaaaaacggagcgctgcttgatgagaagaaaaactcctcgcaaagaccaaaaaatgacttaacatatgatgaaatttccattgtttctgagcatttagaagaacttccgggaatcgatatcgtaaacgattggacacgaaaatatccttatgacaaaaccctttattctgttttcgggggcgtcacgacacctgatcagggcctgctgagcgaccggaaagatttctacttaacaagaggctatgcgaataatgacagggtgggaaaaagttatttagagtatcaatatgaagaatatttaaattcgcataaagaaaaagtggaatacgtagaagataataaaggaaatgtcgtcagccaaaaaaccattgataagggcagcaggggatacgatcttcagctttcttttgacatggagcttcaggcaaaggtagaaaagattattgaagaagaagtaagaaacagccgtgcacgcggaaattacatgcttgacagagcctttgccgtaatgatggacccgaataacggcgatattttatcaatggcagggaaaaagatagatttaaaaaccaacaaaattgaagattatgcgataggggcatttaccacccaatatgaaatgggatcagcagtaaagggggccaccgtgctagccggctatcaggacgggatcccgcattataaatattttgttgacatgccactgtattttgcaggaaacggtaataagcctaagaagtcctatatgaatatgggaactattaatgaattaacggcattgcaaaaaagctcaaacgtatacatgtttaatgtcgccatgcacattgccggtgtcacatacaagccgcatggacctcttcctgctgaccagaaggatttaaacaaaatgagaaattactacagccaatttggcctgggagtaaagacaggcatcgatctgccgcaggaatcagccggtatgcaaactacacctgatgcggtaggggggttaattttagacttggccattggacaatacgatacatatacaccgcttcaaatggctcagtacatctcatcaattgccaatggggggtaccgcattcagccaagaattgttacaagtgttcatgagcccagcaaaaaagaaggccttgggaagaccattgaacaaagaaagccaaacattctcaacaaaattaacaactcagaaagtgacattcagcaggtgaagactggaatgaagctagttaccacttcgggaacagctagaaatacgtttgcagaggatgtttccggaaaaacaggaactgctcaaacattttattacggaacaaatcgtaattggtggggaaaaagcacgtacaatctaacatttgtcggctattatccgtcaaaaaatccaaaagtggctttcagtgttgttgttccttctgtagcgaacgaccacgacccgatcaacaaactcattgccaaaagagctatccacgcctacgcagagctcgaaaaaaaacacagtaaaaaataaaaaacagggtgcacaactaaaagattgtgtgccctttcttttattcaaaaattgacgttcaccataagaatagaaggagaatactcattttctagcgaatcatactaggtaaaagtcaatctgtatatgtcgaaacacgatgatcatgcaaaggagggattctgtggaacaggatacgcagcatgttaaaccacttcaaacaaaaaccgatattcatgcagtcttggcctctaatggacgcatcatttatatatctgccaactccaaactgcatttgggctatctccaaggagagatgatcggatcattcctcaaaacgtttctgcatgaggaagaccaatttttggttgaaagctatttttataatgaacatcatctgatgccgtgcacctttcgttttattaaaaaagatcatacgattgtgtgggtggaggctgcggtagaaattgttacgacaagagctgagcggacagaacgggaaatcattttgaaaatgaaggttcttgaagaagaaacaggccatcaatccctaaactgcgaaaaacatgaaatcgaacctgcaagcccggaatcgactacatatataacggatgattatgaacggttggttgaaaatctcccgagtccgctatgcatcagtgtcaaaggcaagatcgtctatgtaaacagcgcgatgctctcaatgctgggagcaaaaagcaaggatgctattattggtaaatggtcctatgaatttattgaagaagaatatcatgatatcgtgaaaaacaggattatacgaatgcaaaaaggaatggaagtcggaatgattgaacagacgtggaaaaggcttgatggcacacctgttcatttagaagtgaaagcatccccgaccgtctacaaaaaccagcaagctgagctgctgctgctgatcgatatctcttcaaggaaaaaattccaaaccatcctgcaaaaaagccgtgaacgatatcagctgctgattcaaaattccattgataccattgcggtgattcacaatggaaaatgggtatttatgaatgagtctggaatttccctgtttgaagcggctacatatgaggatttaattggcaaaaacatatacgatcagctgcatccttgcgatcacgaggatgtaaaagagagaatccaaaacattgccgagcaaaaaacagaatctgaaattgtcaagcaatcctggttcacctttcagaacagggtcatctatacggagatggtctgcattccaacgaccttttttggtgaagcggccgtccaggtcattcttcgggacatctcagagagaaaacaaacagaagaattgatgctgaaatcggaaaaattatcaatcgcagggcagctcgcggcgggaatcgcccatgagatccgcaaccctcttacagcgatcaaaggatttttacagctgatgaaaccgacaatggaaggcaacgaacattactttgatattgtgttttctgaactcagccgtatcgaattaatactcagtgaactgctcatgctggcgaaacctcagcaaaatgctgtcaaagaatatttgaacttgaaaaaattaattggtgaggtttcagccctgttagaaacgcaggcgaatttaaatggcatttttatcagaacaagttatgaaaaagacagcatttatataaacggggatcaaaaccaattaaagcaggtattcattaatttaatcaaaaatgcagttgaatcaatgcctgatgggggaacagtagacattatcataaccgaagatgagcattctgttcatgttactgtcaaagacgaaggggaaggtatacctgaaaaggtactaaaccggattggagagccatttttaacaacaaaagaaaaaggtacggggcttggattaatggtgacatttaatatcattgaaaaccatcagggagttatacatgtggacagccatcctgaaaaaggcacagcgtttaaaatttcatttccaaaaaaataaaacaacggcttaaacgccgttgtttatcgtctgcattgcttcacgtttttttaatacaaataattctaaacggttcaggccttctctcagcgtgtccagcgagtacgcaaaagacaatcttacatatccttcaccatatgttgagaacgagctgcccggcacgagtgccacaccagcgtcttccaaaagagccatactaaaatcaaatgaagtcattccaaatgatttaatagaagggaagatataaaacgcaccggacggtttaactacgtcaagtcccatagaaacaagacggtcataaacatagtcgagacgttttttgtattgttctctcataattagtgcatcgtcaaagccgtttgtgacagcttcaagcgcggctttttgagaaatggatgaggcacatgacacattgtattgatgaacctttaaaatgtgctttgcaatgtctttcggtgcgaataaaaatccaattctccaaccggtcatgctgtgtgattttgacaacccgttaatgacaatcgtttgatcccgcaaataggttgcgatggagtaatgcggtctgtcatatgttaattcactgtatatttcatcagacaatacgaagacatttctgccttttaagagagctgcgatgcttttcagttcttcttcagataaagtcacgccggtaggatttgacggataaggaagcacgacacacttggtgttggatgtcagagcatcttcaatcagccgggcggtaagcttaaagccgtgtgacgtagtatcaacaatgacaggcttggccccgcacaaattgataataggttcatagcctggataaataggtcctggcataatgacttcatcaccgggagataaaatcgtccggaatgcagcatcaagggcttggcttgcgcctgttgtgatgataatttctgattcagcatcatagttgaaatccgcttttttcttcatataaagctgaacagcttgtctcagctccaggtagccggcattcggagtatatgacgtcacgttttcatcaatggctttttttgcggcagctttcacatgatgcggtgtgaaaaaatcaggctggccgattgtaagtgaaatgacgtcttcgtgttgggctacaagattcgagaatttgcgtattcctgaaatttcgatctctcttgctttcggattcagcaaatgttccataattcatcaccttaacaaatataatgagtttatcctattttaccactagctgatcatttgtcacctttttaactgatatatttcgattgtatgcgccttttttctaaacatacctttcttttcagaaaaaaagaagacaaccagcgatttgattgtctttattgtatcatgttctattattgtttatatgtgccaatttcattaatagccataatcaaaatgaaggtcttcgtgccaaattagatacggaggatgctcttcttgaaggtcagctgattctttcttcatattcaggtaagtttcttcactgatatcctctaaaacagtcatttcgttttctttaaatattactaaggtacccattatttacacccttctttggaaaaatccttgactattttatcactgttagttggaaagtcaatggttattaggaaaaaagtttcttttttgaggaacgcggcttgttgccttcggaattcgattttgaagagctgccattcactttttacaaattacgccgatatatacagtacaatactgaatgcgaatagcgagggattgaattgtcgttacaacaatacgaaattttattggattctggtacaaatgaattagaaattgtgaagtttggcgtgggtgaaaatgctttcggaattaacgtcatgaaggtaagagaaattattcagcctgtcgaggtgacatcagtgcctcactcccatcagcatgtagaaggaatgattaaactcagaggagaaatcctccctgtgatcagtctcttctcattttttggagtagagcctgaaggatcaaaagatgagaaatatatcgtgactgaatttaataaacggaaaattgtttttcatgtcggctgtgtttctcaaattcacagagtatcctgggaagcgattgaaaagccgacatcgttaaatcaaggaatggagcggcaccttaccgggattattaagctcgaagacctgatgatctttttgcctgactatgaaaaaattatttatgacattgaatcagattcaggtgtagacacgtataatatgcataccgagggcttcgatgaaagaagaactgataaaaagcttatcattgtagaggactcaccgcttttgatgcgcctcttgcaggatgaactaaaagaagcagggtacaacaatatcgcttcgtttgaaaatggaaaagaggcatatgaatacattatgaaccttgctgaaaacgaaactgatttatcagaacagattgatatgatcatcactgatattgaaatgccaaaaatggacggacacaggctcacaaagctgctgaaggaaaatccgaaaagctcagatgtgccggttatgattttctcatcgttaattacggatgatctgcgtcaccgcggcgaagttgtaggcgcagatgagcaaatcagcaagcctgagatcagtgatttgattaaaaaagtggatacgtatgttattgaataaataaaaacagccgttgccagaaagaggcacggctgtttttattttaaaagtaactctcgccaagttttttaaagaccggtttatggtaagctggctgctggcgatttggcactagcggcttttctttcatgccgacatattcttgcaataggtgtttcgcttttgttaaagacatttgagctttaggatttcggtacgattgattaagtgtacctaaatgcggaagatgttcgaagtcttctttagttggaggcatgtgaaaatagtagtctccgattgagataagcacgtccgattgctgttggctgaaccttggattttttgaaaaatgaagccctattttctttcctttaccttctttgacaagcttttgcaaagcccgttttttcagcagatataggtatttagggttgggggcggtttttgcatggcggttcacagtgtaaactgcttttgaaagattttctacggttggctgcagatctttcgtatatgcatggtcgtccattatttctctcctttgctcttatcaatttctatatgtttagattatacttttttaaagttgaaatgcaaatattgaatgtaaaaatgcgcttttttctaagaaaaaaagcgcatttttaacctgcattatacagatcttgccttctttttcggctgttcttgaaatgcttcctgaacattcacttccacagcctgagcactgtattttggcagtgcaataaaataaaaaataaaaacgagcaggataataacacccatcccgtaataaagataatcaatgtttgaaacaaacttagggaataacagtgcgactaagccgagtgtcaaagactgtgcaaacatcataaaagggtcctgcatgccgcttacacgtcccatcagttttggatgaacaatttttggcatccaccctccgattgcaatgttgatcggtccgatgcacattcccagtgcaaaagctgccgcgtaatacacccataaaatattggtgtagccgaggacgaagatcagcaaacctgcaatgaaaatcggtatcgacattaaaaagtgcggcttcacttttttagagatgatcgtgccgattacgctgcctgccagcagcccaaacccgagtgcgatcgtaaatacagacgtatgccactcataacggtcaggcgccaatccatatttcattgtaaacatcggcaaaacggcgaatcctccattgacaaatccaaaaatgaagaagccaaaaataagagatgccagcaatttgttttttaaaatatagaggatgccttctctaaagtcatttattgaatccttaacagaagtctttctccagctgaatgcaccgtttggctgtcgggcttcttttggaatccggcagctgcggatcagcagcccggaaatgataaagctgacaaaatcaagaataatggcgccttcaataccgatggtgttgtacataaacgcgcctataccgaccccaaacaccataaaaatgctaaaaagcatctgattaagtcctgccgctttcacataatgctccttcggcagaatggcttgtaccaaactgttttctgccggaaagaaaaactttgttacagcgcttctgataaataagatacaaaaaacaagaggaatattgccggtaaataaagtgaaaaaaagcacgacagtcaggcctgctctgatccaatcacaattttctgccaccttttttctgtcaaaccggtccgcgacgactcccacgatcagaaatacaaatatggtcggaagagaatacatcagctccgccaaggtcgtatatgaaggctggctgctgaatcggtccagcaaaaaaaaagcaaaggccatgttgcctactgtcgtgcccatttgagaagcgagtgctgcgaaaaatagacgaacaaaattacgatttttaaatatatccataaaaacgctccttaccctaaaggtcccactttatcatattataaaccgcctgtttttgaaacaaataagaaaacattaccggttaatcgtgactctcgttccgtttggcacaattgaagcaagttcgatcacgtctttgttatgcatgcgaatgcagcctttagaaacagccttaccaatcgaagcgggattattcgtcccatgtattccgtagtgctgctttgaaaggctcagccaataagcgccaaatgggccgccgggattgcgctggcggttaataatgtaaaactcgccagtaggcgtttgcgttagtattttaccaacggcgatgggataggttttcattacccgattatttaggaacagcgtaagggtcttcgctccgattgagactgcgatatgatacggaattgtataagggtccggcagtccggggatgactatggactgtcctgcggtgagccctgcctgcagtgacggattagcctggagtaatgcagccgtgctgattctgaaatcagccgcgatgctgttcagtgtatcaccttgcttcacctggtacgtaagcagtttcctcatcctccttttttacttataagtattgatggggagcccatcctgctacattaatttgctttttaaggtgaagacagtgatttcaggcttggccagaaaccgcaaaggcagcctggtcatcccgaggcctcggtttacgtaaatatgagtgctgcccgtttgatacattccctctgtgtagacttttccatatggaggcgtaataatcggtccgtaaaaaggcagctgaatctggccgccgtgtgtatggccggaaagctgaaggttcacgggataatctgttgttttcaaggccgcatcaggttcatggacgagaagaatggaaaaaagtctgtcgctcagccttgaaagggtgccttcataatctgggtttcccagcattaagtcatcaagcgaagcaatctcgattttgctgccatctgcgagtgacaatgtttgatagccattgcgatataccgtgaaacctccggccgtcatcaggcttttgtaaacggcagttccatagcctccgtgatcatgattgccgtaaatacaaagcttgccgaagggagcattaagctttctcaataatggaatgactgcctggtggtgctgatacgtatcaggattatcaataatatcacctgtaaaaacaatgagatcaggtttagattcattaattgtaagaatgacagtttttaaatcttcgagagtaaagtaatcactcaagtgtgcatcgctgaactgcacgattttaaaaccgtcaaatccgtgcgggatgagagagctttttattgtgtgttcggttgtctcgatcatatgcggctcgagatacctggcatagccatatcccccgccggccgttaaagccccggcagcaagagcgccgaacattccttttagaaattgtcttctggacatctttttcatttcaaaccaacctttaatagagtttttctattatatcatctgtatctgataaaaatctcatatgagcatgtgctgacagaggcagggatataatgatagaatattattgaatgaatactcattcacaattggagggataaacatggaaaaaaaggcggtaattattaccggcgggtcaagcggaatgggaaaagcgatggcaaaaaaacaggctgaattagggtggcacgttatggtgacagggaggaaccatgaagcacttgaggaaacaaaaaaagaaattgagacctttgaggggcaggtcgcttgttttcaaatggatgtccgttccgattccgccgcttcagacatgataaaagaagcgataaaagcctttggccagcttgacgcgctaattaacaacgcggccggaaactttatttgtccggcagaaaagctgacgcccaatggatggaaagccgttattgagattgttttaaacggcacatttttttgcagccaagcagcggcaaggcattggattgaccagaagcagcagggtgtcattttaaatatggcagccacgtacgcttggggagcgggagcgggggtcgttcattccgctgcagccaaagcgggggtattgtcattgacaagaacgctggccgttgaatgggggagcaaatacggcattcgcacaaacgcgatagcccccggaccgattgaacgaacaggcggtgcggagaagctatttgaatcggaaaaagggatggcccgcacgatgaacagtgtgccgctcggccgattgggcacaccggaggaaatcgccgctttggcagcgtttttgctttctgatgaatcatcctatataaacggggattgtatcacaatggacggagggcaatggctgaatccttatccgttttaaagaatattaatctttggattcaatgtggtataatcagacaaagatagagaagcaggtgataacatgttggatccacttgatattttaacgaacattgatgatgtccttccatattaccaggcgatttttagtgccgaggagcagaaggttgtcggatatgaggtgcttggacgaattttggcagattcagaaatccaaagtctcgggcccttctttttagatgcggggatacccgaagaatataaattagaggttgataacagaattatccgccaggctcttgaccgctttttagagtcggattctgatctgctgatttttatgaatcaggatgccaatctgctgatgctggatcatggtgaaagctttctggagcttctgaaagaatatgaagcgaagggaatcgaactccaccgttttgtgcttgaaattacagagcacaattttgaaggggatattgagcagctctaccatatgcttgcatactatcgtacatacggaattaaaatcgcagttgacaacatcggaaaagaaagcagcaacttggacagaatcgcgctgctctcaccagatctgttaaaaatcgatttgcaggcgctgaaagtgtcacagccgtcaccgtcatatgagcatgtgctgtacagcatatctttattagcaagaaaaatcggtgcggcgctgctgtatgaagacattgaggcgaacttccagcttcagtacgcctggagaaacggaggccgctattttcagggctattacttggtgtctccatctgaaacgtttctagagagagatgtattgaaacaaagacttaaaactgaatttcaccaatttatcacacatgagaaaaagaaactggagaccgtctatgagcactctgaacagttttacaaacgagtgcatcaggctgtgacctctttgagaaaaaacaatctgtcttctgatgatgactttattaaaaagctggcggaagagctgacagattgcagcttcaggatttacatgtgtgatgaagaaggcgatcagctgacgggaaatgtgtttaagcaagatggagaatggatttatcagccggaatatgcggaaaagaactggagttggcgcccttattttctggagaacattatgagaatgagaaatctcagaaaaggttttttcagtgatctgtacagtgatttggaaacaggtgaaatgatcagaacgttttcatatccgatggatgatcagatgtatttatttatagacttgccttattcttatttatatgagcaggacggactgatttaacggctgaaaggccgttttttttatgaaatgaaaaaaatatcaaaaaacgattgacattgatactgagaatcattatcatttaattatagagagaagctactctctgttccccaacccctctatcagatcaagatccgaaaaaacttggcgctacccccgccaagttttttatttgtcaaagcataggacaatccaatgaaacaataaacctaactagtggtaaacgtttaacactgggagaaacattcagtgccgaacacccctgacactgctgcacgggtgaggaggaaaattcgttctgaaatgtttatttcagttccgttgtttgcctctatccagcatgactcccattgattatggccacgcgggacttcaccataacattcaaaagaaggttttgacaaagttgcaaaaaggcattcttaatgctgccaaagattcgaaaaaaattataattgtgtgcatgacattcaaaaaaagcctcaaactaaagaaaaatcgtttttttcactttttttctttgcttaaattcagcagtgaaaatgccatcctgtccgactttatggtatgatgctcaatagaacttgtattataataaatacttgttgatttgaagttgctttttgaaaggagtctttttttagaatgtcacaattaatgggtatcatcacacggctgcaaagtctgcaagaaacagcggaagcggctaacgagccaatgcagcgttatttcgaagtgaatggtgagaaaatatgcagtgttaaatatttcgaaaaaaatcaaacgtttgaactgacggttttccaaaagggtgaaaaacctaacacgtatccgtttgataatatcgacatggtttccatcgaaatctttgaacttcttcagtaagattcctgaaatagggggaacaagcttccgcctttgcaaaagtaatcgaaataaacggtaaggaacatacttgtttcatggttgtaaatccttgaaaaggagtgtcgtgatggctgattcttttctgttttataatctttcagaagcacagatgacctttcaagatgtgatggaacggcttaaagcctttgttcaaaaggacccccgttcttcttatgtgttatcgatcggaaccgattcacaggtttaccgcgattacacaaagtttattaccgcattgcatttgcatcgtacaggcaagggagcttggggctgcttaaaaaatcatacagtcgacagacccatacatagccttcgggagaagatttcgttagaaacggcgtacagccaagaaacggccgctcatattcttgatggacacttaatggatattaccgatctgctcctgccctttaccggtgagggggcggatcttacctttgaagttcacttggatattgggaaaaaagggcttacaaaagatctgatccaagaaatgactggacgtattacctccatggggattgaggccaaaataaagccggattcatacactgccttcagctatgcaaatcgtttcacaaaataatttggctgaaaaagccaaggtaaatgtcgaattatgcggttgacgtttgttatctgattacttattctagcggtagagctgaaagtaagttgtcttgctttcagaggtattcagtataaaacagggggcctgattgcgaatgagtcttatcggtgaacgatttacagaagaagaacaaaaacttctgctgaatatcctgatcaaccatgagtatgccatcgagctattaagcagtgagatcaacgatatagagacagggaccaaaaacgttgacggaaccacctacaaaaaacttgtaacgctatacgaccgatttcgatttgaaaattaatgggacaccctataattgatactccacaaagagtatcttttttattgaaaggaaacttttcgacaaatactgataaagtttatattattgcaatatagggaatgtattgatgatgaaaatgaaaaggggtcgaaaacatgataagcttacaatcagatcaacttcttgaggcaacagtcggacaatttatgattgaggcggacaaagtagcgcacgtgcaagtcggaaataaccttgagcacgcattattagtattgacaaaaaccggatacacagccatcccggttctggatccttcctaccgtttacatggcttaatcgggacaaatatgatcatgaacagtatttttggacttgagcgaattgagtttgaaaagcttgaccaaatcactgttgaggaagtcatgctgaccgacattccgcgccttcatatcaatgatccgattatgaagggattcggcatggtcattaataatggatttgtctgtgttgaaaatgacgagcaggtatttgaagggatttttacgagaagagtcgttttaaaggaattgaataagcatatacgctcgttgaataagtaggctgtacggcctatttttattatatagccagagcgaaaaaaagaaagcgcatacataatttaaacgagaatagggcttgaataagaaactaagattttattagaatgggagataagaaaaacttattgataacaaaaaggaggacgacatgcagcttcaagagcttcatatgctcgtagttttagctgaggaattaaatatgagaaaggcggcagaacggctttttgtatctcagccggctttatctcagcgcttacaaaccattgaaaaggcgtggggaacaaaaatctttttaagatcccaaaaaggattaacggtaacgcccgccggtgagaaaatcattcagtttgcgaatgatgtgacattagagcaggaaagaataagagaaaatattgacgagcttgaaggtgaaattcacggcacattgaagcttgccgtcgcctccataatcggtcagcattggctccctaaagtcctgaagacgtatgttgaaaagtatccgaatgcaaagatctcgctcataaccgggtggagcagcgaaatgctgaaaagcttgtatgaggatcaggttcatatcggcattataagaggcaaccctgagtggaaggggcgcaaagattacttaatgacagatcatctgtatttagtggatactgaaatttcctgcatcgaagatattgcccatacagaacggccgtttatccagtttaaaagtgacagcacttattttcaggaaattcagcactggtggcatcaaaaatttaaaacgtcgccgaaacagacgatattggttgatcagattgaaacgtgcaaacagatggcactgcacggaatcggttatgccattttgccgtctgttacccttcaaaatgaagataaagtgaataaaatgcctcttttagacatgaaagggcatccgatcggtcgggatacatggttattaggttatgagcctgcctttgaactgaaacaagttcaagcttttgtacaagtgataaaggatatgctggaccaggaaaatccattttaaagacagcgaggtgctgtctttttttttatttatctgttgacaatgaaaatcattatcatttaaagtgatacatatgatattgaaaatcattatcaattaatggggtgataacatggctaaagccttgattacatatgccagcatgtcaggaaatacagaagacattgccttcataataaaagatacgcttcaggaatatgagttggatatcgattgtgtcgagatagatgatatggatgtgtcttgcttaacctcctatgattatgtactgattggcacctatacatggggggacggcgatttgccctacgaagcggaggattttttcgaagaggtcaaacagcttcagcttcatggtttaaaaacagcctgcttcgggtctggcgattattcttatccaaagttttgcgaagcggtgaatttgttcaatgccatgctgcaagaggcgggagctgctgtttaccaggaaacactaaaaattgaattagcgcctgaaacggatgaagatgtggaaagctgccgagcgtttgcgagaggttttcttgcatgggcagattatatgaacaaggaaaaaagccatgtttcataaaggagcaactgctgttacggcatcggcgttttctggatattttgtggcggtacaaagagaaggcatttttcattattctttggagcagggctggagaaagctttttcgtttgaaaagtaagatacactgtatcagctacatagggccttacttatttggtgttggtgaaaagggaacagtcattcgttcggctgatgaagggaaaacctggacgatgtcgagctttccgacaaatgcaacagtgtgggcgattaccggcagaaacaacgggtttgtctgcgcccacggtaagcattgtatttatgtatcggatgattttggtgtctcatggcgcgtagccaaaccttttgccgaatttcataatccccctgttatccggtcgctatgccttcacgggggcaatctttttattggcacgcaaatacacgcatattttggcggcatttgggcttacgacattaagcgtgacactgtccaaattgtcaaaaaagaaaaaaaacggatgacggcatccatgctcgtgttcaatgaaaattggctggtggcggcgatgggttctgtgaaaggaaagcacggtgctgtcactgtacggaatcttttgaatggtgaagaattcaccatacaatccagtatgatcagaaatgaagaatcatttcttgatctttcagaggatgatggcattatatatgtcactacaacacaagatgaaaatggtttttcgagaatttaccaggttgatctcgaagcccgatcgttaaaatggttcgataccattaaggggcatggatggagagtggccaatcagaaagagaatttcttttgcgcaggcttgtatgaatgtaaatttgtccagccgtacgaagtttcagcaatgattcattagaggaggaacaaggaattggcgaagattttgctcgtttatgcaacaatgtcaggcaacactgaagcaatggcagatttgattgaaaaggggctacaggaggcggaagcagaagtagaccgtttcgaagcaatggatattgatgatgcccagctgtttaccgattatgaccatatcataatgggaacctatacgtggggagacggagatctgcctgatgaatttttagatctggctgaagacatggatgagattgatttttccggcaaaacatgcgctgtatttggttccggtgatacagcatatgaatttttctgcggagcggttgatacgctagaggcaaaaataaaagaacgcggtggagacattgtgctgccttcggtaaaaatcgaaaataatccagaaggtgaagaagaggaagaattaataaacttcgggagacaattcgcaaagaaaagcgggtgcgctgtctgatcactcactgggaactgctaaaacggctgttcctttttttcttgtctttgtatctttcctttgatacagtaatgaggtagaaaatcaggaggaggactatacatatgaaaatgatggacgcaaatgaaattatttcatttattcaaaatagtacaaaatctacacctgtaaaggtttacgtgaaaggtgagctggaaggaatcaatttcggtgaatctgcgaaagcttttatcaacggaaacactggtgtcgttttcggtgaatggagcgaaatccaaacagcaatcgaagaaaaccaaagcaaaatcgaagactatgtggttgaaaatgaccgccgcaattctgcgatcccaatgcttgatcttaaaaacatcaaagcgcgtatcgagccgggcgcgatcatccgcgaccaagttgaaatcggtgataacgcagtcatcatgatgggtgcttctattaatatcggttcagtcatcggcgaaggcacaatgattgatatgaacgttgtgcttggcggacgagctactgtcggaaaaaactgccatatcggcgcgggttctgtacttgcgggcgttattgagccgccatccgctaaaccggttgtgattgaagacgacgtcgtaatcggcgcaaatgctgttgtgcttgaaggtgtaacagtaggtaaaggagctgttgttgctgcgggagcgatcgtggtaaacgacgttgagccatacactgtcgttgcaggcacaccagctaaaaaaatcaaagacattgatgaaaaaacaaaaggcaaaactgaaatcaagcaggaattacgccagctgtaaggaaaagtttgataaaaaaggcgtggataatatatccacgccttattcgtataggcaggaggaatagaaatgaagaaagaggagctcatcgcaattcgcagagatctgcatcgtataccggagcttggatttcaggagttcaaaacccagcagtatttattaaatgtcttggaacaatatccgcaagacagaattgaaattgagaaatggcgaacagggctttttgtaaaagtgaacgggacggcgccggaaaaaatgctggcgtacagagccgatatcgatgcgctttctatagaagagcaaactggtcttccattcgcatcagagcatcacggcaacatgcacgcctgcggtcacgatttgcatatgacgattgcactcggcattattgatcattttgttcaccacccagtcaaacatgatttgctttttctgtttcagccggcagaggaagggcctggcggtgcggaaccaatgcttgagagcgatgtattaaaaaagtggcagcctgatttcatcactgcgcttcatattgctccagagcttccggtaggcaccattgcgacaaaaagcggccttctatttgcgaatacatcagagctagtcatcgatctggaaggcaaagggggacatgcggcatatccgcatttggctgaggatatggttgtagcagcaagtacacttgtcacccagctgcaaacgattatctctagaaacacagatccgctagacagtgctgttattacagttggtaccattaccggaggctcggcacaaaatatcattgcagaaacggcccacctggaaggcacgatccgcacgctttctgaagaatcgatgaaacaagtaaaggaacggattgaagatgtagtgaaaggaatcgaaatcggattccgctgcaaaggaaaagtgacatatccgtctgtatatcaccaagtttacaatacgagcggattaacagaagaatttatgtcttttgttgctgaacatcaactggcgacagtaattgaagcaaaagaagcaatgactggagaggattttggctacatgctgaaaaaatatcccggcttcatgttctggctcggcgctgattctgaacatgggcttcatcatgctaagctgaatcccgatgaaaatgcgatagaaacagcggttaatgtcatgacaggttatttttctgtttatgccaattaagcacaaatgaaagaataaaattccataaaatgagcactctagtaaacggaggtgttcaaaaatggctaaaaaaattggaattgaacaatcgttatcagatgtagaagctgctttaaaagaaaaaggatatgacgttgtaatgatgaaaagccctgctgatgctcaaggctgtgactgctgtgtcgtaacaggtcttgataataatgtgcaagggatagccgatacggtaacacaagcacctgtcattacagcttccgggatgacggctgaagaaatttgcagcgaagttgaaagcagaattcagtaatataaaaaccgaagcaaaaagcttcggttcttttatttattctgtttctttagggaaagcgcggtcgaacgcgttctttatttcttttctcaacactcgttcgactcgccactgttccatattttctgttttggcaatgaccctgattacaatttcggaagtccccagttcttgaatgccgatgacatttgggccttcttttatttgtggaagagccgctgcagtttcatcacaaacctgctgtaaaatatgaatcatttcatcaatatttctttcagccggcactttaatgtcaacaagagcctgcatggtaccacgagaatgattgctcacgtttgtgatgtttctgttggggatgtaatgcagtgttccgtcaaagctgcggatttgagttgtccttaagccaacctgctcgacaattccgtcaaaggtggaaacggtaatataatctccgacatccaattgtttctcaagcaaaataaaaaaacctgtcacgatatcactgacaagcccttgggcgccaaatccgacagccaggccgacgattcctgcccccgctaaaagagcgcttggatcataatgaaacaaatctagaaccatgacgaaaaatatgaaaatcaatgtataagcaaatatgttaagagtcaggcttcggagcgtatgtgcacgtccgatagacaagctattctgctcctcgaattttgcaaacagatgtttaatgattttcatgcctaatgatcgaacgataaaatagagcaatatcataatggcgagtttaatgagcagaacaccggcatttgtaatcagtcccgcccaatcatattgtttaataaagtccatgttgagctccttttctaattgattgctgcacattgagactagttaccctgtacatgaccatgttaaacgttttattcaaaaatgtcgaagccaaagacatacatgatttgttaaaaattgactcaggaaatctgcttttatataatggcattgcaatataactaaaaatggttaatcaccctttattttcatgcgattttgacctttaagccaaacaataaattggagggatacatatggcagaacgtatggtaggtaaacaagctcctcgttttgaaatggaagcagtccttgcaagcaaagaattcggcaaagtaagtcttgaggaaaacatgaaaaacgacaaatggacagtgctgttcttctatccaatggatttcacttttgtttgtccgacagaaattacagcaatgtctgaccgctatgacgagttcgaagatcttgatgcagaagtcatcggggtttcaactgataccatccatactcatttagcttggatcaatacagaccgcaaagaaaacggtcttggccagctgaaatacccgcttgctgctgatacaaaccatgaggtatcccgggaatatggcgttttaatcgaagaagaaggtgtggctttgcgcggattgtttattattaatcctgaaggggagcttcaatatcaaactgttttccataacaatattgggcgtgatgttgatgaaacgcttcgtgttctccaggcgctgcaaactggcggactctgtccggctaactggaaaccaggccaaaaaacactttaattctttccaagaacgaaaagcggtctagcatattcgttaggccactctgttaaataggagggaaaaagcaatgaaattacgtcagtccatgccggaattgacgggagaaaaagcttggttaaatggtgaagtgacgagagagcaattgattggggaaaagccgacgcttattcatttctggtccatcagctgccacttgtgcaaagaagcgatgccgcaagtgaatgaatttcgtgataaatatcaagatcagctgaatgttgtagctgtacacatgccccgttccgaagatgatcttgaccttggtaaaattaaagaaacagctgctgaacacgatatcactcagccgatttttgttgacagtgaccatgctttaaccgatgcatttgaaaatgaatatgtacctgcatattatgtgtttgataaaacaggacagctccgtcacttccaagccggcgggagcggtatgaaaatgcttgaaaaacgtgtgaaccgcgttctggctgaaacggaataggtatctgactaaatagtatttcctaaaaacctgatcacatcaggttttttatttgtgcaaaaagcaatggaagaagagtaagaagcttatttttccaaatttgggtataggaattgatggtttgtttgattgatacgctagaaaacacagctaatttttgatgtttttcctcaattttagataaatctcatatctcataactcgaaaattgtagatattacactaaatttctttaaagaagtaagtaaaatatatattttcaacattataccaaataaactagaaagccccttaatcccttgagaataaaggactcttttgaaaaataaaacattttcagaaaataaggaatttttcatagagtaaatataatagtaaaatgctaaaataatagttgataaaattacttttgtaatctaatatcttaattaaagatgttaattttgatagggggtacattgaggaatgtttaatgaaagagaagctttgcgcttgcggttagaacaattaaatgaagctgaagtgaaagtcattcgtgaatatcaaattgaacgtgataaaatatacgcaaaattaagagagctggacagaaatggaagcccttccgaaatcaaaaaggatttccgttctgaaaaaaaacctgactctctgccggttctcgctgagcttgcggctcaggaaatcagaagctatcagccgcaatcacagcagcagtctgttcagcctcagcttcaatctatttcctctcttcctgccggtataccagacggaacaacacgaagaagaagaggaacggcaagaccgggatcaaaagcagctaagctgcgtgaagctgctattaaaacattaaaacgccacaacgcggcgattaagagctcggagcttcaaaaagagattgaaaaagaaagcggtcttgaaatccctaatatgacaacgtttatgcaaagcttaattaaaatgtacccggaagtgaaaaagccatatcgcgggcagtacattttagagggtgaaatcgaatctgcagaatcagcaaatgaataaatataaagaaaaactgcttggcatcgctcaagcagtttttttattgaggttttttctgtgaaggtttgttttctttttcaagattaagcttatacacccacttttgataaggcttttcttcagcggctctgtttctcagctcttcgattgtatggctcttggcctggtctgatgattgggcgtgggcaagctgtttttggagcacatgtatctgtttggtgacatcttcaaggatggtctctacatgatatggctgcgcgtaggccgctggagcttcttcttccgttttttctttttgtttcgtgccgccatcaatatcggcaaaatgagaagcaatccaggcatcgctttcatcaagctgccgtttatacgatataatagtttcgtgaaataatttttctttcgttttttctatgtctagcagtctttctttcgtttctatgattcgatctttcatatgatcaacttctattttaatatgttttagctgatattctttttctaccatttgctcttttagacgcccgttttcggcttttatcaattcggcttgctgttttgcctgaagcagtgcattttgttcctgctcaatcgaggcttgaagttcgctgatccgtttatgaagatttttattttcttcttcgattttgactttcgcaatatgaagtttatgtttttcttcgatttcggctctgcgtttataggtttcagcagatagaagctcctgcaaaacaacgattttatcaagcagttcagctcttatttggtgcagggtttggctggtgtgggaggcatgtttttcttttgttgacatatgtgttaattcggcagacagctgctggagtttttctttcatatcggtattttctttgagcagtttgttatttttctgatgaaagtagcttgcttcaagttcagaaatcagcttatggcaccttgaaagctcggattttaaataaaggttctcctgagacacgtcgtggaaaaaaggacctgatcttttcattcgaaccatctccctcatgatgttaacactacaatatgcaaatactgaacagctattcctctttaataaacagacaagcagtagcgttgagcctttgcttttgctatgcttttaacgaaactagaggtgagatgatatgaagcatgtaaacgtactgctggcagggggagcctcgcggcgatttggagaaccgaaggcgtttgtcaaatggaagggcaggatgctttacgaatgcgctaaagaggcacttggagaacaaacggttatcatcagccgtcccgaatttattgatagatttcaagaaaacggtgaaaatgaagtgtatcaagatgctgagccatttcaaggcatggggccattggctggtatatataccgcttttaaaaagacagacggtgatctttatactgttctttcctgtgacacaccgctgatacaaagaaggacgatactggagctcaaacgtctgatgactgccggttcggacgcggtagtcccaatttcagacggacaagtgcagccattgattgcgatttaccacaaacgtatcatgccagttctatacgatcagctttctgagaagaggttgagaatatcagatttattaggcagaatttcggtttgttacgtacaggctgaaaatatcggagcaaacccggcagagtttatcaacattaatacacgtgatgattttagctgtttggaagaaaaatcgaactccctcaagcgggactgacggggcaataacatgataagatgacataaaagataaggagaacaggtttgatggaggaacgttattcacggcaaatcagatttaagcaaattggggaagagggtcagaaaagactggcagacagccatgtgctgattgtcggagcgggagcgctcggcactgcaggagctgaagggctttcgagagcgggagtcggtacgattaccattattgaccgtgactatgtggagtggagcaatcttcaaaggcagcagctttatacagaaagcgatgccaaactccgcatgccgaaagccatggctgccaaagagcatctatcagcgattaacagcgagatacatattgaggcgtatgttaccgaaggaacagccgaaacgcttgagccgctgattgaaaaagcagatgtcgtgatcgacgcgacagataattttgaaacccgcatgctgataaacgatcttgcccagaaaacaaagacaccttgggtctatggcgcctgtgtaagcagccagggaatgttcatgactgtcattcccggagaaaccccttgtctgtcttgtttgtttgagcaaattcctgtcggcggggcgacgtgtgatactgccggcattattccgcctgctgtgcatatcgtttcagcatatcagcaggctgaggcatttaagctgttaaccggccaaatagaagcaatacagcggggttttgtgacatttgatgtctggaacaattcgcatatgaagattaacgttaatcatgtacgccgtgaggattgcccatcttgcggagcaaatgcggtatatccttatcttcaggattggaatacaccaaaagctgctgtattatgcggccgtgatacagtgcaggtaaggtcagaatcattaaaaagaatcccgaaacaggaactcattaagcggctgaaaacaatcggcaaggtcgaggctaatgcgtttttgctgcatattttttacgaggatttcagaattgtcattttcaatgacggacgggcactggtgcatggaacaaatgatgtgaaagaagccaactccgtgttggcaagagtgattggactgtaacaacaggaggggtcagaatgctggagaaaagaacaccgataccggtagacgaggcagttcggcgtgtctgccattttcaaaaacaaggtgaaacagaatgggtggcgcttgaagacagccttcatcggtttttagccgaagatataactgcggatcaccacgtacctgcgtttgaccgttcgccatacgatggttttgctgtcagagcgtgcgatacggcagaagcttcacgtgaaaacccagttcggtttgaagttattgaccatattggagcaggagcagtatctgaaaaagaacttggcccgtttcaggccgtgcggattatgactggcgcgcaaatccctgaaggggcagatgcagtcgtcatgattgaactgactcaaacctttgaggagaatgggaagtcatttatgtctttaaaacgccgctttcagacgggggataatatttcaaaaacaggtgaggacgctcaaaaagggagtgttttactgacaaagggcacccgggtgacaccaggagtgacggctcttttggcaacattcggatacgcatctgtgcctgtcgtgagaaagcctgtagtcgggattatcgcaaccggtaccgaattgctgaatgtcagtgatccgctggaaccgggaaaaatccgcaacagcaatgcgagtatggtatatgcgcaagcgatagaagcaggcgcaacaccgctttatttagggaaaatctctgatgaattggataaaagctttgctgcagttaaagaagcgatgaaaaaggtggacttcctgatcacaactggaggtgtgtcagtcggtgactttgactttttgcctgcgatctatgaaaaactcggagcggacgtgctgtttaataaagttgccatgcgcccgggcagcgtgacaacggtggcgcatgcaaacgatatgctgctgtttggcctttcaggtaatccgtcggcatgctatgtcggttttgaactgtttgtcaaaccgataatccagacatggttgctcaatgaaacaccgcattcgatttgtgcggaagctgttttgaccaaggattttccgaagccgaacccatttacccgatttgttcgtgcgctcgtgcaccatcaggaagggaagctgttggcgacacccgttggcttagataagtcgagctctgtcacatcacttgcagatgccaatgcatttattatcctgccgggcggcacgcgaggctacgaatctggcagaacggttcaagtgctgctcatcagagaagagaatggaagtgaatggccttggtccgtcctttcccgatcgtccaagttgtaggatttcaaaacagcgggaaaacaacgtttattgagcgcattcttgaaaaagcctctgaacaaggagtctgtttgggctgcctgaagcatcatggtcacggcggtgaaccgcaagcgctcacggaaggaaaagacacggaccgttacaaggcggcaggtgctgatgtaacagcggtagaaggtgctggtgtgttacagctgactgcccgccgcaattgggatttggcacggctgatcgagttataccaatttctcgaaacagactgtcttctgattgaaggctttaaaaaagccccttatcctaaagtggtaattctaagtgaaaaggaagatctggaagcgctgcaagcagtaaatataatcgccatcatctatagaaaaaaagagcatatgacagagcatcagggattacccgtttttcatgcggatgatccggttgccgtggattttgtgctttcacagctgaagggggaatctgcataatggaacggtttgagattacgaaaacacccattaatactgaagacatcattaaaaaagtggagaaacgggaagcaggagccattacgacatttattggtacggttcgggaatggacaaacggaaaaagaacggttcggcttgaatatgaggcatatgaaccgatggccgtgcaaatgcttgctcaaatcggcgctgaaatcgaagaaaaatgggaaggtgcctcagctgcgatcacgcaccgtataggtgtgctcgatatcggtgaagcagcggtagtgattgctgtatcttctccccatcgaaaagccgcatatgaagccaatgagtatgcgattgaacgcattaaacagattgtgccgatttggaaaaaagaaatttgggaagacggtgagcaatggatcggcgaccagctagaaacaacagcttatccgaacggaaaaccagatctaagcgagggagaccagcatgattaaaattcttttatttgcaggactggctgaacaggccggtacacaagcaatagaaatagatgtggaacaagcaaccacagatgaaataaaagcgagtctaaaagaacaatacggtcttgaatctattgatacgtctatgattgccgttaacgaaagctatgtaaaagaaaatacctctgtatcttcgggtgacacggtagccgtcataccgccggtcagcgggggatgaaaaccggacggcatttcagccgtccggtttttctgtatttcattggcatatccccaagtatcctcagcatacaatgattttctgtaagcgtttattctacatatgttactccctataaagtaagagactcactccataattagactgaaattttgaaaaataatagaaatttatttcgggtatcgatatagtgaagatgataaatgttggaaaggtgctggatatggagacatttaaaagattaaaaatgtattattggccgtacagaaaagtgtttatgtggtcgcttctagccatgcttttgatgactgcaattactgtcgtttatccgattatcctgcaaattacgattgatgagatcgtgctgggacggcagtatcagcttgcggcgtgggtcagcttaggatttattgcggtaatggttttgaaaggaatggctaccttttttcatcagtatttaggtgatatgttcgggatcaaatccgtttatcggctgagaaatggtctgtatgaaaaactgcagcggctttctttttcttactatgataacgcgaaaacaggagatttgatgtccaggctgactgctgatgttgaagggcttcgttttttcttatcatacggtctcgctgagctcattcgcttcggcctgctggtagccatcagcctgtcggttatgttttactattctgttcctctcacgcttgtgacaatagctgttctgccatttctcgcggttgcggtataccggtttgacaaaagagtccatcccgccttcagaggcatccgcaaatcgtttgcgaaactcaatacaaaagttcaggaaaatatcagcggcattaatacggttaaatctctttccagggaagattttcagatcagcactttcaataaagccaatgcagaatacagggcgcagtatttacaaacatcatccatctggtctgcgtatttccctttaatggagttcattggtaacatttgtattgtagctcttctctcatacggcggttacttggttatgcaaaatcagctcaatcccggcgagcttgttgctttcttcagccttgtcaattatatgatgtggcccattatgaacttaggttttgtcatcaatatgttctctcaagcaaaagcgtcaggggaacgcctgctcgacattctggaaaaagaagaagacattacaggtcatcctcatgctttgcataaacaaaaattaaccggagatgtccatttcaaaaatgtttctcttgcatacggaaaagaacaaacaaacgcgctgtgcaatgtaagctttgaggcaaacagcgggaaggtaatcggactgttgggcccgacaggttcaggcaaaagctcagtgacacagcttctcaccagattttacagtcctgttagcggaatgattaccattgatcacaaaccaatcacagattattcgttaaaaacccttcgctccaatatcggggtcgtacttcaagaatccttcctgttttcatctacgattagatcaaatatttcgtatgggcggccggatgcctcaatggaagacgtcattgaagcggcaaaaagggcgcaggctcataactttattatggagcttcctgataggtatgacaccatgctgggagagaggggaatggggctttccggcggacagaaacagcgtattgccattgcgagagccatctgcttgaacccgagcattttaatattggatgatgccacaagcgcagtagatatgcaaacggagcacagcatacagcttgccttaaaagaagtcatgaaaaaccgcacaacctttatcgtcgctcaccgcatttcttcactgaaacacgctgatgaaattctcgtttttaataaaggacgcattcgtgaaaggggaacacatcatgagcttcttgaaaaaggcggctactataaaaagatttacgatttgcaataccgtgatgtcaaaatgattaatgagccgcatgaggtcggatagggaggggccaaatgaaacaagcgaaaaaacaggggattttagagcgtttctattactcttcagatgaaatcattgaaaagccgtttaactgggctcaaatgtggcggctgctgagctatgtcaaaccatatcgaaaaacaattttgccgctttcttttctcaccgtattaattggcactgctgtgaagcttgtgatccccattttgatcggcgtttatgttcttgatcaagcgattacaaggagaaactcggagctgctgattcagctcatttttattattagcggtttatatgtcctcaattacgccgccaatgtgttaagaattaggtggatgaatcagcttggccagcatgtcatttacgatttgcgacagcatttatttacccatgtgcagcgcttatcccatcgattttttgatcagcggtcggcgggatcgatcttagtcaggatcatgaatgatattaactctcttcaggagctctttacaagcggagtcatcaatttgttgaccgacttgctgcttctggccggcgtgattattattttgtttacgctgagccctgagctgactatagccatcatggtgacattgccgattatgttttttatttcaacaagtctcagaaaaaaaatacgccgatcctggcaaacggtacggctgaagcaatcgaagctcaactctcatctaaacgaaagcattcagggcatccgggtcacacaggcatttacgcaggaagaagaaaacatggcgtattttgacggtgtcaatcaggagaactacgaatcatggcgggaagcaactagaaaaaatgccatgttccgtccgcttgtagaaatgacgaatgcgattgggacggctgtcttgatttggtatggagccacactcatcatgaatgaaaccattacgattggcgtcttcgtttcttttgctttctatctgggaatgttttgggaacctatttcgagactgggtcaggtctataatcagctgttaatggggatggcatcatcagaacggatttttgagtttctggacgaacagccaaatgtcaaggagaagccgaatgccattcataatgaaaagataaatggggagatcagttttgaagaggttgaattttcgtatgatgaaaaacgaaaagccctttacgccgtttctttctctattccggcgggctcgacgcttgcgcttgtcgggcatacagggagcgggaagacgacgattgccaatttaatcagccgtttttatgatgcgaccggaggcaccattaaaatagacggtataccgattaaggatctttcccttgccagtctgcgctctcaaatcagcattgtcctgcaagatacatttattttctctgggaccatcatggaaaatattcgttttggaaggccaaatgcttcggatgaagaggtgatgaaagcgtcccaagcggtcggagcggatgagtttatttctgatttagcagaaggatacgcaacagaggtggaggaaagaggcagcgtactgtctgccggtcagcgtcagcttatttcctttgcaagagcattgctcgccgatccggctattatcatccttgacgaagcaacggcaagcattgatacagagacagaagtaaaaattcagcaagcgttaaaaacgcttctgaaagggcgtacagcagtgatgatcgctcacagattgtctacgatccgcgacgccgaccgcatcattgttcttgatcacggcaggaaaatagaagaagggaaccatgatcagctgctcgctaaaggaggcatttatgccgggcttgtgaaagcgcaatacagcacagcgatagaataatatgaaaagccttcaatattgaaggcttttggaaatttattagaaaaacatgaaactttttgatatccttcccgtactatttgttagatattctcaaggaggttttgaaatggaaacgaatgtagaaaaaaacagcggaacggcgactgaaaagccttcacttttaggagtaatcacaagtccgtccgttcaatttgaaagaataagagaaaggccggctgtatggggaccgcttttgattgttgcagcaattatcatcgtcggtgccgtgctgcaatcactcggtacggattatagtgagcttttgaaaagccaggatacgcaagggctatctgctgaacaaatggaaactgtcgcaacaataaccaaagttggcggaatggcaggcgctattatcggcggtatcgcagcattatttattgcccctcttatttattggctctgtgtaaaagtatcaggcggtgttacgacatataaaaaaatgctttctctcggtctgtttgtctctttgattagcagtctcggattattggttaatggaatcgttgcttttacgactgacgtgaatcctctttacagcacgacgtcactggcagggattatcccatctgacggggctcttgccagcgtgttaaatacctttgaaattttcagcatctggagctttgtattattagcaatcggacttcacaaaacgggaggcatctcaaaaaaagccgggtggatttcagcaatcattctattcggaattttagttgtattttcgcttttttcaggtttaatcaattctgtggcgggtgcataagctcatgaaaaaagtctggatcggaattggaatcgcagttatagtcgctctttttgttggaatcaatatataccggtctgccgctccgacaagcggcagcgccggcaaggagatacagacggggagcgttgaagaaaatgaaatctcatcaacggttatggttcctggcacgctaaaattttcaaatgaacagtatgtcttttatgaagcggataaagggacattagaagacattaaagtaaaggaaggcgataaagttaaaaagggcacggctttagtcacctatacaaatgagcagctgagcctggaaaaagaacagaaccagttaacgtctgaatccaaccggcttcaaattgaccaaattcaagaaaagttaaaagccttggacagcaaagaaagagaactggaaaaacaggtaggaaagaaagaagcagaaaaacaaatcgaatctgaacggacagagcttcaaatgcagaaaaaaacagcggagatcgaattaaaacaaaccgagcttcagcggcagtcacttgccaaccgggtgtcagatttagaagtgaaaagcgaaattgaaggcaccgttatttctgtcaaccaagaagcggcatccaaaaagtcagatattcaagagcctgtcatacatatcggcaacccaaaagaccttgtcgtctcagggaaattgtctgaatacgatacattgaaagtcaaaaaaggccagaaggtcacactcacttcagatgtaatacagggtaaaacatggaaaggcacggtttccgcagtcgggcttgttccggatcagcaggagagcgctgcggcacaaggaacagaacaggcggtccaatacccgcttcaagtgaaaataaaaggaaatcttccagaaggaaagccaggctttaaatttatcatgaatattgaaacagataaacggaaagcaaatacgcttccttcaaaggcagtcaaaaaagaagatgaccaatattatgtgtatacagtaaaagacggaaaagcaaagcgagttgatgtcaaaatcggcgaagtgacagatgacctgacagaaattaaagaggggcttacccaagatgatcaagtcattttgaatccatctgatcaggtgactgacggaatggaagtgaaatcctaaatgattcagctttctaatgtgcgaaaaagctaccagatcggaaaggaaacgtttgatgttctccattctattgatttggacattcatcaaggtgaatatgtctcgattatggggccgtcaggatcaggaaaatcgacgatcatgaatattatcggctgtcttgatcggccgacttccggtacatatcaattggacggcgaagacatttcttcatataaagataaagaactggcggcagtccgtaaccggtccatcggttttgtatttcagcaatttcagcttcttccgcggctgaacgcaaaaaaaaatgtcgagctgccgatgatttattccgggataggcaaaaaggaacgtcaagagcgggctgagagagcattggaaaaggtcgggttagccgatcgaatgctccacatgcccaacgagctgtcgggcgggcagaagcagcgggtggcgattgcgagggcgatcgtgaatgagccgaaattgattttagctgatgaaccgaccggcgcgctggatacgaaaacaagcgaggcgattatggatcagtttacagcattaaatgccgagggaacgacaatcgttctggttactcacgagcctgaagtagcagattgcacgaatcggatcgtcatggtgcgtgacggaaacattgttcctgccagctccggacaaaggagtgtgggagaatgagcctgttggaaaacatcagaatggctctaagctctgtccttgcccataaaatgcgttcgatcttaacgatgctcggcattatcattggtgtaggctctgtcattgttgtcgttgcggtaggacagggcggcgagcaaatgctgaagcagtcgatcagcggcccgggaaatactgcggagctgtactatatgcctagcgacgaggagcttgcaagcaacccgaatgccgcagctgaatctacgtttacagaaaacgatattaaaggtttaaaaggaatagaaggcattaaacaagtcgttgcttcgacttctgaaagtatgaaagcgcgttatcacgaagaagaaaccgatgctacggttaacggaataaatgatggatacatgaatgtcaattctttgaaaatcgaaagcggcagaacctttaccgacaatgactttctcgcggggaatagagtcggaatcatctctcaaaaaatggctaaagagctgtttgataaaacctcccctctaggtgaagttgtctggattaacggacagcccgttgaaattatcggcgtgctgaaaaaagtaacaggcttgctttctttcgatttaagtgaaatgtatgtgccatttaatatgatgaaatcctcttttggcacaagtgatttcagtaacgtatcattgcaggtcgaatcagcagacgacataaaatcggctggaaaagaagcggcacagctggtaaatgacaatcatggcacagaggattcgtatcaagtgatgaacatggaggagattgcggccggaattggcaaggtaacggcaattatgacgacgattatcggctcaattgcaggtatttcccttttggtcggcggaatcggtgtcatgaatatcatgctcgtatcagtcacagaacggacacgggaaattggaatcagaaaatccctcggtgcgacgaggggacagattctgactcagtttttaattgagtcagtcgtattgacgctgattggcggtctggtcgggattggtattggatacggaggggccgcgcttgtttcagccattgcgggctggccgtcactcatatcctggcaggttgtatgcgggggcgtgctgttcagtatgctcattggtgttattttcggcatgcttcctgcaaataaagctgcaaagcttgatcccattgaagcgctgcgttatgagtagcctcatgcaacatgcatgaggtttttttatgtttagtgatttctactatgaatataaaagacttttttcattaaaataagaagaaaatgtcgtacaattgtccttatttttgtcgaatttacagtttacaaaccctatagacatacgttaatatggagaaacgtgaaagattttgatagttattgaatgaatttgaatgattttagttgcctaaaccgaaaatagcgtttacaatgaaattgtattcaaaatgaatacgttttcattaggaggtgaagcatgctaactcctgaacggcatcaattgattattgatcaaatagaaaagcatgatgtggtaaagattcaagagcttataaatctgactaatgcttctgaatcaacaatcagaagagatttatcgacccttgaagaacgcggttttttaaagcgcgttcatggtggagcggccaagctttctgatatcagacttgaacccgatatgcttgaaaaatcatccaaaaaccttcacgataaattgaagattgctgaaaaagcagcttctcttttagaagaaggggattgcatttaccttgatgcaggcacgacgacattgcacatgattgattttatggataaaaccaaagatattgtcgttgtcacaaacggggtaatgcatatcgatgcattaataaggaaagaaatttctttttatctgcttggaggatacgtaaagcacagaacgggcgcgattattggaggcgcttcattgattgccatggaccagtacagatttgacaagagttttctggggacaaacggtgtccatacagaggctggatttacaacgccggaccctgatgaggcccttttaaaacagaaagcgatcaaacaggcaaaacacgcttacgtcttagcagacccttcgaagttcggagaaatttcattttcggcattcgccggaataggcgacgcaacaatcattacgactgacgctgaagagcttacattcgataattaccaagaaaaaactgtcgtaaaggtagtgaaaccatgatttacactgtaacacttaatccatctgtcgattatatagttcacgttgaagatttttctgtaggaggcctgaaccgttcttcgtatgataccaagtatccagggggcaaaggcatcaacgtatcgagactgctgaaaagacaccatgtggcgtctaaagcgctcggattcgtcggcggatttaccggagaatatatcaaaacatttttacgggaagaaaacctggaaacagctttttctgaagtaaaaggggatacccgtatcaatgtaaagctgaaaacgggtgatgaaactgaaattaacgggcagggaccgacaatttcggatgaagatttcaaagcctttttagaacagttccaatctttgcaagagggagatatcgttgttcttgcaggaagcattccatcttcactccctcacgatacttatgaaaaaatcgcagaggcctgcaaacagcagaacgcacgagttgttctggatatctcaggcgaggctcttttgaaagcaacagaaatgaaaccatttttgatgaagccaaatcatcatgagcttggagaaatgttcggcacggccattacatctgttgaggaagccgttccttatgggaaaaagcttgtagaacaaggcgctgaacatgtaatcgtatcaatggccggagacggagcgcttctgtttacgaacgaagctgtttattttgctaacgtgccaaaggggaaattggtaaactcagtcggagcaggggattccgttgttgcaggtttccttgccggaatttccaaacagctgccgcttgaagaagcattccgcttaggagttacttcaggcagtgctaccgcgttctctgaagaacttggaacagaagaatttgtccagcagcttcttcctgaagttaaggtcacacgtctatagaggaggaaacacaagtgaaaataactgagcttttaacgaagcatacgataaagcttaatattgagagcaaagaaaaagaaaatgttattgacgaaatggtcactgttcttgataaggcaggaaagttaaatgaccgacaagcctataaagaagccattttaaatcgcgaaagccaaagctccacgggtatcggtgaaggaatcgctatcccccatgcgaaaacggcaagcgttatcaacccggcgatcgcgttcggacgttcaaaagacggcgtcgattatgaatcattagacggccagccggctcacttagtgttcatgatcgcggcgactgaaggcgcaaacaacactcaccttgaagcattgtcaagactttcaacgctgttaatgcgtgaagaaatccgtaagcagctccttgaagctgagtctgaagatgccatcatcgacattattaatcagcacgataaagatgatgacgaagaggaagaggaagaagaagcggcaccagcacctgccggaaaagggaaaattttagcggttactgcatgcccgacaggtattgcccatacattcatggctgcggatgcccttaaagaaaaagcgaaagagcttggtgtggaaattaaggtcgaaacaaatgggtcaagcggcattaagcacaagctcactgcccaagaaatcgaagatgcacctgcaatcattgtcgcagcggacaagcaggttgaaatggaacgttttaaaggcaagcgcgtacttcaagttcctgtaacggcgggtatcagacgtccgcaagagcttatcgaaaaagcgatgaatcaagatgcgccgatttatcaaggcagcggcggcggttcagcagcttcaaacgatgatgaagaagcgaaaggcaagtctggaagcggtatcggaaacacgttttataagcacctgatgagcggtgtcagcaacatgcttccgttcgtagtcggcggcggtattctcgttgcgatttcattcttctggggaattcactctgctgatccgaatgatcctagctacaacacgtttgcagcagcattaaactttatcggcggcgacaatgcattaaaactgattgttgcagttctggccggtttcattgcgatgagtattgcagatcgtcctggttttgcgcctggtatggtcggcggatttatggctactcaagcgaatgctggattcttaggcggcttaattgccggattccttgccggttatgttgtgattttactgaaaaaagtatttacgtttatccctcagtcacttgatggattaaaacctgttttgatttacccgctgttcggtatttttatcactggcgtattaatgcaatttgtcgtcaatacacctgtagcggcatttatgaatttcttaacaaactggcttgaaagccttggtactggaaaccttgtgttaatgggtattatcttgggcggcatgatggcgatcgatatgggtggcccgcttaataaagcagcctttacgttcggtatcgccatgatcgatgcaggcaactatgcgcctcatgcagcaatcatggccggcggtatggttcctccgcttggtatcgcacttgcaacaaccattttcagaaacaaattcactcagcgtgaccgtgaagctggtattacatgctatttcatgggagctgctttcgtaacagagggagcgatcccatttgctgcggctgatccgcttcgcgtcataccagctgctgtagtcggtgcagctgttgccggcggattaactgaattcttccgagtaacgcttccggcgcctcatggaggagtattcgtagctttcattacaaaccatccgatgctttaccttttaagtatcgtgatcggtgctgtcgtgatggcaattatcctcggtatcgtcaaaaaacctgttacagaaaaataagaaaaaaagcgtccttggttcgaaaggacgctttttcttatccggccggcagggagcgcggttaagttatgtattttattcttttttatgataaagtaaaagaagagaaacaactgacatagcaattgtctaggaggaaacactttgaccgaggaaaaaaatacgaatactgagaaaacggcgaagaaaaaaaccaatacgtacctggaatggggtaaagcgattgtcatcgctgttctgctggctctcctgatccgtcactttttgtttgaaccgtatttagttgaaggttcatctatgtatcccacattacatgacggagaaaggctgtttgtgaataaaacagtcaactatatcggcgagctgaagcgcggagatatcgttattatcaacggtgaaacttctaaaatccattatgtaaaaagattgatcggaaagcctggagaaaccgttcaaatgaaggatgacacgctttatataaacggtaaaaaagtagccgagccttacttgtctaaaaacaagaaggaagcagaaaaacttggtgtcagtctgacaggagactttggaccggttaaggttccgaaaggcaaatactttgtcatgggagataaccggctgaattctatggacagccgaaacgggctgggactgatcgcggaagatcgaattgtcggcacatcgaagtttgtctttttcccgtttaacgaaatgcgtcaaacaaaataaaaacgccttgctggcctaggacagcaggcgtttttattttgaaaaagaagcgaccaatgcaatgcataaaaccgtgatgaacactgaaccgataatagctagcacactgaagaaaaggtgaacctgtttgttctcttttccgcgcttttctaaaagccgtttagaaaaaatgtgcgaaaatatgtaaataagggctatgcctatatataagccgatatctttggcggtaaagcctgttacggcaaggtaaaagcccgtaaaaaagatcagtaagcaatattcagtaagtgttaaaagcctcaacgtgttcctccatgagagtgtgtaattttccaggcggatgcattctctctctttaattgtaacacagctggctggtttgggtgtataagtgttttctctctgttttatcagggaatcatttctcttgccctgcattcatggtatacttttattgatgatagacatgatggaggataataaatgattgctgtaaataatgtaagcttgcggtttgcggatcgcaagttatttgaagatgttaatattaaatttaccccaggcaactgctatgggttaattggtgcaaacggtgccggtaaatcaacgtttctaaaggtgctgtcaggcgaaatcgagcctcagacaggcgacgtgcatatgagtcctggcgagcgtcttgccgtcttgaagcagaaccattttgagtacgaagagtatgaagtgctgaaagtggtcattatgggccacaaacgcctgtatgaagtcatgcaggagaaagacgctatttacatgaagcctgatttctcagatgaggatgggattcgtgctgctgagctagaaggtgaattcgcggaactgaacggttgggaagcggaaagtgaagctgcgatcctgttaaaaggccttggtatctcagaagatctgcacacaaaaaagatggcagacctcggcggttcggagaaggtaaaagttctcttggcacaggcattattcggcaagccggatgttctgctcctcgatgagccgacgaaccacttggaccttcaggcaatccagtggcttgaagagtttctgattaactttgaaaacacagttattgtcgtatcccatgaccgccacttcttaaataaagtatgtacgcacattgccgaccttgattttaacaaaattcaaatctatgtcggaaactatgatttctggtacgagtcaagccaactggcgttaaagctttctcaagaagcgaacaagaaaaaagaagagcagattaaacagcttcaagagtttgtcgctagattcagcgccaatgcgtctaaatctaagcaggctacatcaagaaagaaacttctcgaaaaaatcacgctggatgatattaaaccgtcttcccgccgctatccttatgttaacttcacgccggaacgggaaatcggaaatgatgttcttcgcgtggaaggcttaacaaaaacaatcgatggcgtaaaggtgcttgacaatgtcagctttattatgaatcgagaagataaaattgctttcactggccgaaacgaacttgctgttactacgctgtttaaaatcatttccggggaaatggaagctgacagcggaacgtttaaatggggtgttaccacatctcaagcgtattttccaaaagacaacagcgaatatttcgaaggcagtgatctggaccttgtagactggcttcgccaatattctccgcacgaccaaagtgagagctttttacgcggtttcttaggacgcatgctgttctctggagaagaagtccacaaaaaagcaaatgtactttctgggggagaaaaggtccgctgtatgctgtcgaaagcgatgctttctggcgccaatattttaattttggatgagccgactaaccatttagacctagagtccattacagcgctcaataacggcttaatcagctttaaaggcgctatgctgtttacttcccatgaccatcagtttgtgcagaccattgccaacagaattatagaaattacacctaacggcatcgtcgataagcaaatgagctatgacgagttccttgaaaatgctgatgtgcagaaaaaattgactgaactatacgccgaataaaaaagcagagatttttctctgctttttttgatacctaaatgtgaaaggagatcacaacatgaaatttttggttgtcggagcaggtggagtaggcgggtatattggcggacggctttcggagaaaggaaatgatgtgacatttctcgtgcgccaaaaacgagctgagcagcttaaagaaaccgggcttgtcatccatagtgaaaaagggaatgtatcatttcaacccaaactaatcagtgccggagaaacagggcaatttgatgtcgttatcattgcttctaaagcatactcgcttggtcaagtgttagaggatgtcaaaccacttatccatcaggaatctgtcattatccctttcttaaacgggtaccgccaatatgagcagctatttgcggcattttcaaaagaacaggtgctgggcggcctgtgttttatagaaagtgctttagacaacaaaggagaaattcatcatacgagcgcatcgcatcgttttgtatttggagaatggaacggcgagcgtacggagcggataagagcgcttgaagaggcattttcaggtgtgaaggctgaagtcatcattagcgggcatatcgagaaggacatttggaaaaagtatctctttattgcagcgcaagcggggatcacaacgttatttcaacgaccgcttggcccaatcctcgccacagaagccggacgtcacacggcccaaactcttattggggaaatttgcgctgttttacgaaaagaaggcgttccggctgatccggatcttgaggaagagagctttcgtacgatgaccaacatgtcttaccatatgaagtcctccatgcttcgggatatggaaaacggccaaacgactgaaggagaccacctgcatggatttttgcttgaaaaagcaaaacgtttatctctcgcagcaccagtattagaaaccgtttatgcgaatctgcaaatgtatgaagcagaaaaataaaaaaaggaggcggaaaagcctccttttatttacttaaaaagcccaatttccgtttctgaagataggctctcttttcccgtctgccgtaattccgtcaatattcatatccttagaaccgatcataaagtccacgtgtgtaatgctttcatttaggccttctttgacaagctcttcacgagacatctgctttccgccttcaatattaaaggcataggcgcttccgatcgccaaatgatttgacgcgttttcatcaaacagcgtgttatagaaaagaatgtttgattgtgatataggcgaatcgtaaggaacaagtgccacttcacctaaatagtgagaaccttcatctgtttccaccagttcttttaaaatatcctcacctttttcagctttaatgtcgactatacggccattttcaaacgtcagggtgaaattttcaataatatttccgccgtagcttaatggttttgtgcttgataccactccgtcaaccccgtctttttgcggcagcgtgaatacttcttctgtcggcatattggccataaactcatggccgctttcattcacgcttcccgcacctgcccaaacatgcttcctaggcagcttaattgttaaatcagttccttcagcttgataatgtaaggcagcgtaatgtctctcgttcaaatggtcaactttttcatgaagattttggtcatgattgatccacgcctgaaccgggttgtcttcatttacgcgtgtcgctttaaaaatttcttcccacagaaggtggatcgcttcctcctctgatttgccaggaaacaccttgtgagcccagcctgctgatgccgcacctacgacagtccagctgactttgtctgattgaatatattgtctgtatgtatgcaatgctttgcctgctgctttttggaatgccgcaatccgtttggaatctataccttttagcaagtctgggtttgacgacacaacagaaatgaaagcagctccatttttggcaagctcttctctgccttttgcttcccattcaggatattcttcaaatgctttaaacggcgcaagttcgtattttaatttggctacttcgtcatcctgccaattcacggtgacgttttttgcgcccttttcatatgcgtgttttacaattaaacggacaaaatcccgaacgtctgttgaagcatttacgactacatactggcctttttggacattaacgccgacttctaccgccagctgtgcatatgtatttaatttctgtgaaaatgaatccatgaatcattcctccaagcttttttctcatcatatcaaatatgatcctataaaggaaagaaggagcccaaagtgaaaaacccaaaacgacacgtcttgggtttttcaatattatggatgattcagttttacagtgccgcctgcaggcgaatggggcatatttgccaaagaaatgctcatgcctccaagaataattccgcttaaaatggctgcgatcgctactcttcttcctaaatctcttagcatctgtttcctccttaacgtttctccatttcccacaatatgaaggaagtgaggaaaaaagaagcaagaaatttgccgcgtgtgagaattttgcgggtaaagactatttaattgccttttgcagcttatcaatcacttctaaagaacggcctgtgccgattgctacagattcaagcgggttttgcgccacgtgtacaggcacgacaatctcttctgtgagccattctttaattccattaaggagcgcaccgccgcctgttaaaataacgccgcgatcaacaatatctccgctcaattcaggcggacagtcctcaagtgtcgctctgatggcttcaagaatatgcaggagggattcacgcattgcatcttgaatttcgttggattgaagcataatggtttttggaagacctgtcacgaggtcacgtccccgaatttccattgcctctggtatatgttcaatcagagcatggccaattttcatttttacctgctcagctgtgcgttcgccgatcagcaaattgtattttttacggacgaaagaaacgatatcctcatcaagctggtctccgccgatcctgatagaatggcaggaaacaacgccaccgaaggaaataatagcgacctctgtcgtccctccgccgatatctactaccacattggcaaccggctcatcaaccggtaaatccgctccgatggcggctgcaactggctcttcgattaaatgaacgtttttcgcgccgcaatttttcaccgcatcactgatggcgcggcgttctactgctgttgagcctgatggtgtgcaaacgactacgttcggttttctgaacgacatgccgatgctttttgcggcttttttcataatgtgctttagcaggtcagttgtcatatcatagtctgcgatcacgccatctttcatcggtctgacagcgacaatttttcccggtgttttaccgatcatgtttttcgcgtcagctccgattgcaagcactgcttttgtcgtcgtatcgactgcgacaacagatggttcatttaggataatccctttatttttgctgtaaacaagtatattagctgttcctaagtcaatcccgatttcagttgattgaaacatgttttcacccaatctctatcctaatttaatatgattctacatttaaagtttctcagaaatactgcgatttttgggggtgtgtgtcggtaaagaaatgtttttgtaaaaaatcaaggaactgtgtaatagaagtaatacatttttcggttttatggaaaaaatatcttgtaattcttatagaaagcgggaaactttttcaaagtttcattcgtctacgatatattgaggtacatccttaaaacattacatgagaaaagaaacatttaaaggaagaagggtttttatgaaatcaataggtgttgtgagaaaagtagatgaattaggccgcattgtcatgccgattgagttgagacgggcattggatattgccataaaagacagcattgagttttttgttgacggagataaaattatcttgaaaaagtacaaacctcatggcgtttgtttaatgactggagaaatcacttcagaaaataaagaatacggcaacggtaaaattacgctaagccctgagggtgcacagctgcttctcgaagaaattcaagccgctttaaaagaataaaattatgctaaaaaaggcggagcgatatcatctccgccttttttgcgtatcaatttttgattaccgccgcctaagataagacatcaagatatttggtaatgaatgatttgggatactttacatattttactcaattatttgtcgaagaatggtacaataagtagagaaacacaagcggcaggtggtcatatgagaaaatatcaagctcgtatcatttccatcattttggcaatgatttttataatgttttgggattatttattttattttataggcaaaaacccgattaattggcctgttgatattgtgtatactgcagtcacgctggtaagtgtctggatgttggcttattatattgatgagaaacagcagctggttaagaaaatgaaggataacgaatggaagtataaacagctttctgaagaaaaaaaccgcatcatggataatttgcaggaaatcgtatttcaaacgaatgcaaaaggtgaaattacatatttaaaccaagcgtgggcatctataaccgggttttcaatcagtgaatgtatgggaacaatgtataacgattacttcataaaagaaaagcacgtagccgaccacattaacacccaaatccaaaacaaagcgtcttctggcatgtttacggcaaaatacgtgacaaaaaacggcacgattttttggggagaagttcattataaactttactatgaccgggatgaccaatttacaggcagcctgggtacaatgtcagatatcactgagcggaaagaggctgaagatgagctcattgagattaatgaacggctggcgagggaatcccagaaactatcaatcacaagtgaacttgccgcaggtattgctcatgaggtcagaaaccctttaacatctgtcagcggtttcctccagattatgaaaacacaatatccggacagaaaagactattttgacatcatcttttcagagattaaaagaatcgatttagtgctcagcgagctgctgctgcttgcaaaaccgcaggcaatcacatttaaaacacaccagcttaatgagatcttgaaacaagtcacgacattgcttgataccaatgcaattctgtccaatatcgtcatagagaaaaatttcaaagagacagatggctgtatgattaatggagacgaaaatcagctgaagcaggtctttatcaacatcattaaaaacggaattgaggcaatgccaaagggcggtgtcgtcaccatttcaactgctaaaacctcctctcatgcagtgataagcgtaaaggatgaaggaaacggcatgccgcaggaaaagctgaagcagattggcaaacctttttattcaacaaaagaaaagggcactggactgggacttcccatttgtttgagaatcctgaaggaacatgacggggaattgaaaatcgaaagtgaagctggaaaaggcagcgtctttcaagtggttttgcctttaaaatcagacagctgagaggagaaaaataaagtgaactcgcttctgtttgtatatgggacattaagaaagcatgaaaaaaaccatcatttgctggcacaatcggcatgtatcaatgagcaggcgagaacaaagggaagtttgtttgctgcaaaagaggggcccacagttgttttcaatgatgaagatgaaggctatatatatggcgaagtatatgaagcagatgaattgtgtatacataagctcgatcaattttttcaaggatatcataaacaaacggtgtttgtagaaacggatgtcgggattaaaattgcgcttatttattttatgaacaaagacgggtgtgccggttttacgaaaataagcagcggcgactggaaagaacatcagatgatcagcaaatcgaaaaatcccatttattattttgcctatggatcatgcatggataatgcccgctttcaaaaagcgggagtcgatcactattttcaagatccagtaggaagagctgttttaaaaggatacacaacccgcttcacgctaaaaagggaagacggttcaagagcggacatgttggaagacggaggaacaacagaaggcgttttataccgtatcccttattctgctctctcctatctatataaaagggagggcgtcgaatctcttacgtatcggccggcatttgtagacgttgaagctggcggaaggcactacaaagactgtttaacctttctcgtcctccaaaaagaagcggaaattgccccgcctcagcactatcagattgaaatcgaacgcggagcggagctgtatttgtcgcctgagtttactgaaaagctcaagcggcatatgaattcgctgccaaaaggataacactgtaacaaaagaatatgataaaatttgatcaatatcatgtcatataaaggagcactacgatgaaaaaagaatttgcggtaattgggctgggccgttttggtggcagtatttgcaaagcattaagcgaagaaggcgtcgaggttatggcaatggatatcgatgaagataaagtcaacgagtatgccaagattgcatctcacgcagttatcggtgattcgacagacgaatctgtcctgaaaaatttaggcctgcgaaattttgaccacgttattgtagcaatcggggaaaatattcaagcgagtattttaacgacactcattctgaaagaacttggcgtccatacgattacagttaaagcgcagaacgattatcacgaaaaagtgctgtctaaaattggtgcggatcacatcgtccacccggaacgcgatatggcaaaacgaattgcgcataatatcgtgtccaacaatgtacttgactatttggagctgtctgaagagcatagtcttgttgaaatcgtagctaacagccgcctggctggaaatacacttctcgatttagatattcgcgcaaaatacggtattaatatcgtagccataaaaaggggcaaggaagttatcgtatcaccgcttgcaaccgaagtcatccaccaagaagatatactcattgttattggatcagttacagacatctcccgtttcgaaaaaagagttcttcatacaaaatagcagccaaataagccgtcctcaaagggcggtttttcatattatcagaatataacaactttaatgaactgagcgtcaatttcttaaaatttcattgactaagcacaggcgttccgatagcatattgtaccatataataaaaaagaggaggggcctatttgaataaagaagcgctagtcaataggctgaatgcttcagccaaaagacaaaaagctgatatcgtcattaggaacggaaaaatcatggacgtttataatcaagaatggatatatgaagatattgcgattacagatggagttattgtaggcctcggtgagtatgaaggtgaaaataccattgatgcagagggacaaatgattgttccgggttttattgatggacatgtacatattgagtcgtcaatggttacaccgattgagttcgctaaagcagtgttgcctcatggtgtgacgacggttgttacagatccgcatgagatcgcgaatgtgtctggtgaaaaagggattgtgtttatgcttgaacaagctcggcatacaccgctgaatatccattttatgcttccttccagtgtgcctgccgcaagttttgagcgatcaggcgcaattctcaaagctgccgatctcaagcctttttatgaagaagaagaagtattagggctggctgaagttatggattatgtgtcggttcagcaggctgaagaagacatggttcagaaactgctcgatgcccgtgtggcaggaaaacggatagacggtcatttagctggtttatcaacagacctcattaacatttacagaaccgcctttgtcttaaacgaccatgaagtaacatcgaaggaagaagcccttgatcgtatcagaagaggcatgtatgtcatgatgcgtgaaggatcagtcgccaaaaacacgctcaatgtgctgccggcggtgaatgaaaagaacgcacgccggttctttttctgtacggatgataagcatgtggatgatttattgtcagagggaagtgtaaaccatcaggtgaaaatggcgattcaagctggacttgatccgtttttagcctatcaattaggaagcctcaatgcggccgaatgctacggattagatacaaagggagcgattgccccgggttttgacgctgatttgctctttgtatctgatctggaaaatgtcactgtcacaatgacgatggtaaaagggcagactgttgctgaagacagcaaagcggtttatcaggatcatgcttcaactgcagcaccagatcaggcactgcttgattctgttaagcttgctgctcctcttaacaaacaggattttcatatgccaatcgattcagaggagcagatcaatgtcattcaaatcataccaaatcagcttgaaacacgattagtacaagttccggctcctgatgcccgcgaatttgagcctgacactgagtttgatttgttaaagattgcagttgtcgagcggcataaaggattaaaagaaaccggacttggtattgtgaaaggttttggattcaagagcggagcgattgccacaaccatttcacacgactcccataatattattgctgtcggaacgaatgatgaggatatcgcggcggcagttaataagctgcaggaaattggcggaggattaacgattataaaaaatggggaagagctccattcagtaccgctgccgattgcagggttattatccgaccaatctgcagagcaagtgaatcaaagcttgctgacgcttcatgataaattgccgttaatcggtttcacaggcggatttaatccatttttgacattgtcgtttttagcgttgcctgtcattcctgatattaaaatgacgactacgggattattcgatgtaaaatcatttcaacacatatcactgcaataaaaagaggcactccctaagggagtgcctctttttttaaacctccataatgatcggcaggatcattggacggcgctttgttttttcgtacaagaaaggtgcaagcgtgtctgtaatctcatttttgatttcagaccattgagtcgtttttcgttccattactttttgtaagtgatttgaaatgagctcttgagcgtcgttgatcaagtcgccagattctctcatgtacacaaatcctctggaaatcaaatctggacccgctgaaatcttgaagtcgtccatgtcaatgctgacaacaacgatgacaagtccttcttcagagagaattctgcgatcacgaagtacgatattgccaatatcaccgataccgcttccgtcaatgtacactgaaccggacgggatttttcctgcaactgaagcctcatcgcctttaagcgctaatacttcaccattatccatgataaagcagttttcctctgggatgccacaatctgttgcaagcttgacatgcatcttttgcattctgtactcaccgtgaatcggcatgaagaatttaggcttgattaaacgaagcatcagcttctgttcttcctgtccgccgtgaccggatgtatggatatcgttaagagggccgtgaataacctcagcacccgcacgatacagctggttgattgttcgactcacgctgattgtgttgcctgggataggggatgaagaaaatacgaccgtatccccaggattgattgaaatttggcggtgtgtgccgtttgcaattcttgataacgccgccattggttccccttggcttcctgtacataaaattgttactttattagcaggcatacgattgatttcgttatgctcaataaacgtatttttaggacagttaatataaccgagtgtctgtccaatttcgatagccgattccatactgcgtccaaatacggcaacttttcttccattttgtacagcagcttcaattacctgctgcaagcggtgaatattcgacgcaaatgtagcgaagataattcggccgtccaccttgcggaaaatgtcatgaatgctttctcctacacgacgctcagacatggtaaactccggattttcactgtttgtgctgtctgaaagaaggcacaaaacgccttctttaccgatttcggccattttcgttaagtttgccggctcgccgactggagtaaagtcgaatttgaaatccccagtatgtacaatgtttccgggcggcgtttttacaacaatgccgtaggaatccggaatactgtgtgttgttctgaagaatgacacagccgttttgcggaactttacaatatcatcctcgccgataatgttcagtttcgtctgtctcaataatccatgctcttcaagtttattccgaagtaagccgatcgcgagttttccgccgtatacaggaatattcacttgtctgagcaggtatggaataccgccgatgtggtcttcgtgcccgtgggtgataaaaagccctttaattttatcttcgtttttgactaaatacgtataatcagggatgacgtagtcaattccgagcagttcgtcctcgggaaacttgatccccgcatcaatcagtacaatttcatcctggaattgcaccgcgtacgtatttttaccgatttcgcccaaacctccgagggcgaaaacagcagtctgatcattttttacaaatttcataccgctcataactccaatactttaaaattttcgctctgttgttcatattctaagaatgcaccatcaacaggtgtaataaactcaatattaaatttcttttctttcagctttgttctgacgtcacgctcagatacgccttcaatataaagtgaatctgtcttttcccgaacaggtacttcgtcagccttctcttgataaaataccttataaatcattccaaatctctccttaaatgccgtatgttagactcgctcattctattatattcgaaaacggaatataaggaaagccttgagcaaaataaggatctctcaaatagtgaaagatcccttgtcaggcaattgctttcttacggagcattccgttccattgtcttctgagtttctttcttaatttacgcagcattagccagtccctcctttaatgaaaaatttgtcccagagttcttttatacaaatagtatacggagattgaggaagacttttcgtggttattaatggaatttaatatgatttttgaacgaaattgtttgctgaatgacaatctttttgtatgatgagggtgggaattgcagaccaagacgataaaggggaagttgcgatggattctaaattaatcttttttgatattgacggcacaatatatgatcatgataagaatataccggaaagtacgagaaaaaccgtggcggagcttcagcgccaagggcatcatgtgtttattgccagcggccggtctccatttttggttaagccgattttggaggagctgggcatccactcatttatttcctacaatggacagtttgttgtctttgaaaatcaagtgatttataaaaatccgctgcctgaaaatgcaatcaggcgattattaaagcaggcggatgaaggcaagcatcctgttgtgtttatggctgaggacacgatgaaagcgactgttgcggatcacccccatgttctcgagggaatcggcagccttaaaacagattatccagagaccgatgaccttttttatgaaggaaaagaaatttttcagcttcttttattttgtcaggatgaagaagaaaaagcttatgccgcttttcctgagtttgatctagttcgctggcatgagctatcgactgatgttctgccgcacggaggttcgaaggcagaaggaatcaaaaaagtgattgagcgtcttccgtttgatatcggcgatacatatgctttcggcgacggattaaatgatttgcaaatgattgaatacgttgggacaggcgttgctatgggaaatgctgttcccgaactgaaagaaatcgcggactttgtaacaaaaccggtggacgaggatggaattgcatacgctgtcaaagaattgggccttttaaaataaagaaacggctggcattgtgccagccgttttctcttttagcgctcaattgcgattgcattttcaggttctttgaaaggattttccttatcaatatgatcatagaacataacgccgttcaaatgatcgatctcatgctgaaacacaatagccggaaatccttttaaacgaatatcaatattttcgccttctagtgttgttccttttactctgatgcgagcatagcggggaacataaccgggaatcgcttcatccacagagaggcagccctcgccgcttgttaagtagcttttttcaactgaatggctgacgatcttaggattaaacagagcatagctgtataatttaccggaagcatcttccgcatgaacggcgatcattcgttttttgatattaatttgaggagctgcgagtcctacgccagggcgcagcttgtatttttcggctaattctggattttggctgtttttaacaaattcgatcatgtcggccagctgctgtttttctgcatcagttggaggcagctcaacaggttcggcagtctctctgagggctggatggccgtcacgtacgatgttttccatagtaatcaagaaacttcactcctaaagcttaatatgtaaattatatcggatttcttcacaaaggtgcaacgaaacgaatgaccagccgtatatggctggtcaatttcatgctgtgtggttagcaacagcctccacctaaataagcagctccgacaatgattaacagaatgaataaaacaacgattagcgcaaaggtgcggccgtagccatatccgcagccaccatatccgtaaccaccataactgcagcagcctccgccgtaaccatatccatacatattacataacctcctcttttaattacgccagagcctttataagtaggcatagcgtctaatataacctatgtaaaaacaaaaaagttgtatggtcatctgtcctgatttttcacttttttgatttaatttcagtattgcatttatacagcacggctattgccaaatgtccccatggattctatagtagaaattgtcaagattgggggatttaacgtgaaagacgctataaaacggcggcctggaatgaagatcggagctttttgtgccatggcactgatattaacaggatgcatgggacaggacccggttgattcagttcatcattcattagaaaaagccgcggaatcggaaaagccgtttcaagaagaacaaaacacactcaaagaattagaggccaaagaaaatcagctttacgatagtgttatgaagctcaatatggatgattataaaaaaattgttgctttatctaataaggcgcttgaaaatgtcagcaaacgcgaagaacacctagagcttgaaaatgacagcatgaaaaaatcggaaacagaatttgaggaagcaaaaacgtcagcggaacatattaaggaaaaagacataaaagaaaaggccgatgccgcagcaaaccatatggagaaaagatatacatcatatggcactatgtataaagagtataaaaaagcgcttgagcttaataaaaaactgtatatgcagctgaaagacaaagatttgacaagagatgatctggatcagcagatcgataaagtcaatgcttcttatgaaaagatccttaaatatagcggagaatttaatgaacaaaccgaaaaatataataaagcccgggaagatttatatgatgctgcaggctatcgtgtgaaaaagagctgactcgatcagctctttttttgaatgaaatgcgattcggatttcgttcaaaattttcatttctattgtagtacagcatagtaaggtatactagtacagttttgggtgcggttggcatctgtttttttgatgaaaatgtaaagcgaatacatttattgaaaatcagcgatgaaaacgattgacggttcttctttatttggtgtaaactaatccatgttaagcggtgttgtattagttttttacaacttcgaaataatacagttcaaagcagagtgtaactatcctacataaaaggttttggcaaactggggatcggctaaaatataatacgacttactgctgatactttagggtaccctaagtttgtatgtataaaaggaatgcacgtctaatgactgtttaaaagaaaggaagaggtgacttagtatggctgcaaaaacgaaaaaagctatcgttgacagtaagaagcaatttgatgccattaaaaagcagttcgaaacgttccaaattttaaatgaaaagggagaagtcgtgaatgaagcggcgatgcctgatttaactgatgatcaattaaaagagctaatgcgccgcatggtatttacgcgtgtgcttgaccaacgctctatctcattaaaccgtcaaggacgtctcggattttacgctcctactgcgggtcaagaagcttctcagattgcaacgcatttcgcgcttgaaaaagaagactttgttcttcctggataccgtgatgtgcctcagttaatttggcacggccttccattatatcaagcgtttcttttctctcgcggacatttcagaggaaaccaaatgcctgatgatgtgaatgccctttctccacaaatcattatcggtgctcaatacattcaaacggccggtgttgcgctaggtcttaaaaaacgcggtaagaaagctgtcgcaatcacttacactggtgacggcggagcttctcaaggggacttctacgaaggaattaactttgccggagcttataaagcacctgcaatcttcgtggtacaaaacaaccgttacgcgatttcaactcctgttgaaaaacaatctgcagctgaaacaattgcacaaaaagctgtagctgccggtattgtcggcgtacaagtagacggaatggatccgcttgctgtatacgcagcaactgctgaagcacgcgagcgcgcaatcaacggcgaaggtccaacactaattgaaacacttacattccgttatggcccgcacacaatggctggtgacgatcctactaaatatcgtacaaaagaaatcgaaaatgagtgggaacaaaaagatccgcttgtacgcttccgtgcgttccttgaaaacaaaggcttatggtctgaagaagaagaagcaaaagtaattgaggatgcgaaagaagaaattaagcaagcgatcaaaaaagctgatgctgaaccgaagcaaaaagtaactgatttaatgaaaatcatgtacgaaaaaatgcctcacaaccttgaggagcaatttgaaatttatacacagaaggagtcgaagtaagccatggcgcaaatgacaatgattcaagcaatcacggatgcgttacgcacagaactgaaaaatgacgaaaatgtcttagttttcggagaagacgttggtgtaaacggcggcgtattccgtgcgacagaaggattgcaaaaagaattcggtgaagaccgtgtgtttgacacgccacttgctgaatctggtatcggcggtcttgcccttggtttaggcttaaacggcttccgtccggtaatggaaatccaattcttcggatttgtttatgaagtaatggattcagtttctggccaaatggctcgtatgcgctaccgttctggcggacgctggacttcacctgtaacaattcgttctccattcggcggcggtgttcatactcctgaacttcacgctgacagcttggaaggtcttgttgcacaacagcctggtatcaaagttgtgattccatcaactccttacgatgccaaaggacttttaatttctgcgatcagagacaatgatcctgttgtcttcttagagcatatgaagctttaccgttctttccgtcaggaagttcctgaagaagaatacacaattgagcttggaaaagctgacgtgaaacgtgaaggtactgatctttcaatcattacttacggcgcaatggttcatgaatcgttaaaagctgctgaggagcttgaaaaagacggcatttctgctgaagttgtcgaccttcgtacagtaagcccacttgatatcgatacaattatcgcttctgtagaaaaaacaggacgcgcgattgtcgttcaagaggcacaaaaacaagccggtattgctgcaaacgtagtagcagaaattaatgaccgtgcgatcctgagcttggaagcacctgtacttcgcgttgcagcgccagatacagtatttcctttctctcaagcggagagcgtatggcttccaaaccataaagacgttcttgaaacagcaagaaaagtgcttgaattttaatcaaactgcataatcgagagggaagatgaacgttttccctctattatatatctgttttcaatgcttacgatgtaaactttaaaattgcttaatcaaactaggaggtcgagaactgtggcatttgaatttaaacttccagatatcggggaaggtatccacgaaggcgaaatcgtaaaatggtttgtcaagcctaacgacgaggtagacgaagatgatgtactggctgaagtccaaaatgataaagcagtagtagaaattccttcacctgttaaaggaaaagtattagaattaaaagttgaagagggaacggttgcaactgttggacaaacgattattacgtttgatgcacctggttacgaagatcttcaatttaaaggcagcgacgagtctgacgatgcgaaaactgaagcacaagttcagtcaactgcagaagctggacaagacgttgcgaaagaagagcaagctcaagagcctgcaaaagctactggcgcaggacagcaggatcaagctgaagttgacccgaacaaacgcgtgatcgctatgccttccgtacgtaaatatgctcgtgaaaaaggcgtagacatccgtaaggttactggttcaggcaacaacggacgtgttgtaaaagaagatatcgacagctttgtaaacggaggagcgcaagaagctgcaccgcaagaaacagctgcaccacaagaaacagctgctaaaccggctgctgcaccagctccagagggcgaattcccagaaacacgcgaaaaaatgagcggtatccgtaaagcaattgcaaaagcgatggttaactctaaacacactgctcctcacgtaacgttaatggacgaagtggacgtaacaaaccttgttgcacatcgtaaacagttcaaacaggttgctgctgatcaaggaatcaagctgacttacttgccttacgttgtaaaagctcttacatctgcactgaaaaaattccctgttttaaacacgtccattgacgataaaacagatgaagtcatccaaaaacattacttcaacatcggtatcgctgctgacactgaaaaaggcttgcttgtaccggttgtgaaaaatgcagatcgtaaatctgtctttgaaatttctgatgagatcaatggccttgcaacaaaagctcgtgaaggcaagcttgctccagctgaaatgaaaggcgcatcttgcacaattacaaacatcggttctgccggcggacaatggttcactccggttatcaaccatccagaagttgcgattcttggtatcggacgcattgcagaaaaagcgattgttcgtgatggcgaaatcgtagcagctccagtcttagctctctctctcagcttcgaccaccgtatgatcgacggagcaactgcgcaaaatgcattaaatcacatcaagcgtttactgaacgatccacaattaattttaatggaggcgtaatgttatggtagtaggagatttccctattgaaacagatactcttgtaattggtgcgggacctggcggctatgtagctgccatccgcgctgcacagcttggacaaaaagtaacagtcgttgaaaaagcaactcttggaggcgtttgtctgaacgttggatgtatcccttcaaaagcgctgatcaatgcaggtcaccgttatgagaatgcaaaacattctgatgacatgggaatcactgctgagaatgtaacagttgatttcacaaaagttcaagaatggaaagcttctgttgtcaacaagcttactggcggtgtagcaggtcttcttaaaggcaacaaagtagatgttgtaaaaggtgaagcttactttgtagacagcaattcagttcgtgttatggatgagaactctgctcaaacatacacgttcaaaaacgcaatcattgctactggatctcgtcctatcgaattgccaaacttcaaatatagtgagcgtgtcctgaattcaactggcgctttggctcttaaagaaattcctaaaaagctcgttgttatcggcggcggatacatcggaactgaacttggaactgcgtatgctaacttcggtactgaacttgttattcttgaaggcggagatgaaattcttcctggcttcgaaaaacaaatgagttctctcgttacacgcagactgaagaaaaaaggcaacgttgaaatccatacaaacgcgatggctaaaggcgttgaagaaagaccagacggcgtaacagttactttcgaagtaaaaggcgaagaaaaaacggttgatgctgattacgtattgattacagtaggacgccgtccaaacactgatgagcttggtcttgagcaagtcggtatcgaaatgacggaccgcggtatcgtgaaaactgacaaacagtgccgcacaaacgtacctaacatttatgcaatcggtgatatcattgaaggaccgccgcttgctcataaagcatcttacgaaggtaaaatcgcagcagaagctatcgcaggagagcctgcagaaatcgattaccttggtattcctgcggttgttttctctgagcctgaacttgcatcagttggttacactgaagcacaggcgaaagaagaaggtcttgacattgttgctgctaaattcccatttgccgcaaacggccgcgcgctttctcttaacgaaacagacggcttcatgaagctgatcactcgtaaagaggacggtcttgtgatcggtgcacaaatcgccggagcaagtgcttctgatatgatttctgaattaagcttagcgattgaaggcggcatgactgctgaagatatcgcgatgacaattcacgctcacccaacattgggtgaaatcacaatggaagctgctgaagtggcaatcggaagtccgattcacatcgtaaaataattttcatatcaaaaacagccctcgctcaaagcggggctgtttttttattttgacagcacatgctgtaatggtttaatgatgtcttctttctttttcacacatccctcgattttcaccacgacatggcgctgatcaacaaccataagggtagggacagtttcaatctcatcttcccagccttcttttttatcatagaccttcattttatctatttgctcgggataatctttttctaaatcaagcagtgcatcgtaataaggcgcttcctggtctatttggttctcatcagaaaaaaacaggatttgtgtatgatgaatgttgtcaatccggctttttttcatcggattgatggtggaaagcgtacagcccgataaagcaaatactattatcagcatggggaataccgcgcgatatcgcatctatcttctcctctgtataaacagtagttaactagctttagtttatcacgagaggcggcttaatctgcttcttgttacctaattgttatataattgaaaccgtttttaaagtgagattacatattatatcaatcgtttaaaatagcaacctggggtatattgaattttttgctgcattcttggatgaaagttcaagaaaacgtgaaattacattatgtgctgtggcatatatatcgagtaaagcttctgtatgaagaagatattgtatgagggaaaatggaaaagcacggtctatatgatgatctaaaattaaatgtgttatacagtttattgttgacattttaaatgtgacatattaatataataacaacaaaagaaattaagcgttttcaaatttcaaagaaatggggaataagagatgggtacgattgtttgccaagattgcaacgaagccattcattactttgaagatgagaaagtgacaacattatacggaacatgctgcggacaatgtcaatgtcctgttgatgaagagtaaaaaaaagcatgcggctttaagccgcatgctttttattttttattgaattgctttttgttctttgatgacccggatcatatgtaaagtcgagtcctcaggtccttgaacagggaggcctgcgtcaaggtttttaaaaatgtagctgatgttttcttctgtaataatttctcctggaatgaagattggaataccaggcggatataccatgacaaattcagcaataatccgtccggatgcttcttttaatgggatgacttccgtatttgcataaaaagcatcacgcggagtcattgccaataaaggtatttctggaagcagaacctcagtttgctgatgtgttacatcttgttctgacatttgctgtgcgatctcagttaaagcctctacaagccggtctgcatcattttggctgtcaccaggagtgaaaatacacaaaatattgtacagatcagaaagctcaacctcaatattaaaggattcacgaagccatttttccacgtcatgtcctgtcaggccaagacttttcacagagataatcaattttgtcggatcatagctgtaagctgctttcgaaccaagaatctcagaaccgacacaataaatgccttcaatctggttgaggcgatctctcgtctgattggcaagcttgagtgtttcctcagcaagctggtggccttctgttgcaaggcgttttctggcaacatccaaagaagcgagaagcaagtaagaagttgacgtagttgtcagcatgctcaggatggattgcactctgtcttttgatacaaggccctctctcatgtttaaaatcgaactttgcgtcagtgatccgcccagcttgtgtacacttgtcgctgctatgtccgctcctgcctgcatagccgatagcggcaattcgtcgtgaaaatgaatgtgaacgccgtgtgcttcatccacaagcactggcacatcaaacgaatgagcgagttctacgatgctttttaagtcggctgcaacaccgaaatatgtcgggttgatgacgagaagcccttttgcatccgggtgctcggtaagcgcccgtttagcagattcaagtgtaattccgtgggagatgcccaattcattgtcaatttcaggatgaataaaaattggaaccgctccggaaaatacaatagctgtcataattgatttatgaacatttcttggaataataattttatcaccaggtccgcaaacagccattaccattgtcataatggcgccgcttgttccttgaacagaaaaaaatgtatgatccgctccaaatgcttcagcagccaggtcttgtgcttgtttaataatgccttttggcgcgtgcagatcgtctaatggttcaatattaatcaaatctatgcttaacgcgttttcaccgataaattgtctgaattctgggtccattcctgccccttttttatggccgggaatatggaattgaacaggctgtctgcttgcatgctttttcagtcctgtgtataagggtgtttcatgttgcgacaattgttttcccacctttgtaatcatacctatgcataatagtgtgtattaaaatcagtttctcaaccgttttttagacgtaaaacaaatgaattatattatgaacttgaaagaatgtaaagaacaatttatgatcaaatgaagatgctttctcttaagggaagtaaatctacaaggagtgaagaaaatggagtatcaatatccgatgaatgaagattggacaaccgaagaagcagtggatgtgattgcatttttccagcaggttgagcttgcatatgaaaaaggggcggatcgtgaagaactgcttaaagcttaccgccgtttcaaggaaattgtaccggggaaggccgaggaaaaaaagctatgcggcgagtttgaggaacaaagtacatattctccttatcgcacggtcaaacaggcgagagaatctgatcaggcgaagattaagatgtaggaaaaagagctgggggatatcccggctcttttttatgcttgtgatactttttgggtgagacggtacagaaaagcaagctgcttaaaggcatcgtcgatacgctgaaggaattcctggttattcatattcagcacttcttctttttggagctggatgccgcataacagctcggctttctttacagtctgcaaacgctcaaacagtgtcttcagctgttccttgtccatttcagactgtttatgtactcccggttttgtgtgatctgcagaccaaacgaagctgtcagggatatttttcgtaatggtttcttggttcatttcaagcaatttgccgtattcttctttgataggggattcataaataatcgcaaaccacacaaagacgtggctttcccataaaccaatttggaaatgcggcagttttttatagcctcttttgctgtttgcgaacgccacccagctgtcagccgggggattgacggatcttcttgcgtgctttgccacatgcgcaaacatttcatctccggttaaagctgataaagttggggcaaaatgttcgcctagagctgtaagcttcggacggaccgtctcttttaatacttccatgcgcgcgtctaagccttctattgtaaaagtgttaaagtcctcttcagtgaaacgcatttgtgtcatgattttcctccttcatgctaagtatacatattttatcacagttcatacgagcttcaaaaagattgagtgcgtttgaagtaaggggaaatgtggtaataaacgaataggtaaacacacaattttcagaatcatgttgcgcgtaaatagaacaatcatacgatataagaagtaatcattgttgaatggcaaaatgggatgcttttttacaaacaaatgatctctggaaggggcgaaagacaatgaggcaagttgtaaaagagggatttaaggaagagaaaaacaatcgtgttgctgtctggagactagaggttgattatgaattggcaaccctatatgaagcaatgcagaaagaaaatgaagagcagattgaacaaagcaaaaacaaacttgagcgacttagaaaagaatggattcgtcttaacgggtaaaaaagcgatagtgaaaacgaaccgcatgaatggttcgtttttacgtgagaagggatatttttcattttccttgctttttcattgccgttatcagtatcctataaaataaaaggtctacatagaagagaggtacgaacgaatgacaaattggacggaaattgatgagattgcaaagaagtggataagagaagcaggcgcgagaattacacaatccatgcatgaaagcctaacaattgaaacgaaatcaaatccgaatgatttagtcaccaatattgacaaagaaaccgaaaagtttttcattaatcgaattcaagaaacttttccgggacatcggatactcggtgaagaggggcaaggagacaaaatccactcacttgagggagtcgtatggattattgatccgattgatgggacgatgaattttgtgcaccagcaaagaaattttgcgatttccattgggatttttgaaaacggtgaagggaaaatcggtttaatttatgatgtggtgcacgatgagttgtatcacgcatttagcggcagaggagcttatatgaatgaaacgaagctggctccattaaaagaaaccgtcattgaagaagcgatacttgccattaatgcaacatgggtaacggaaaacagaagaattgatcaaagtgtgttagcgccactcgtgaaaagagtcagaggcacacgctcctacggttctgccgctttagagctggcaaatgtcgcggcaggaagaatagatgcttacatcacgatgcggcttgcgccatgggactacgcagccggctgtgtgctgctaaatgaagtaggaggcacctatacgaccattgaaggagagccgtttacctttttagaaaaccacagtgtgctagccggaaacccatctatacataaaacgatatttgaagagtatcttcatgctcggaagtaggccatttgagcaggatgatctcagcttgttagaaaagctcgcagaggctcaacctgtatggaaagaggaggagtttggagataaagatgcagaagactatatcatttcctactccatgtacaacggttcatggcttgtatgggaaaaagacggtatgcctgttgccgtcagctaccatctcgagtggtctccttcaaacggtaagccgtggctcggaacggtcctgattgacccggctgaagaaaaaaagggacatgcgaagatgatcattgaacagatcagcaaattgcttagagccaaacacaaagcgatgtttgcgggagttcccattgagcgcagtgaatggatactgtttttaagccaatgcggctttgaacagctgaaaacggaaaaagatgagaaaggcaaatcatttatgatcttggtgaagcctttagcagaagctgccgtatgataacgacagcttatttgctgcatgcgggttcaataaaaagcctctcaaacattgagaggcttctgatgatttgaaaattatttttttactgcatgaatataatgaatcgtttcaaacgctgacaaattgtcttttcgattactaaagaaaaggtcattgatgtcgtctggtgatagatgttcatagatcagtaaaccagatgactctaacagatgttcaatctcttgataagtgaaacatgatttcatcggttccccgcttgcggcagccatcttcaccatatgttcaactcgatttgacgtcccttttgctgtaaaaagtgtttcgtccgcataatcaaaaacaatagagcttccaggcgggacataagaaaataaattgctgatcaagcttgcattttcttcccgtgttacataataagacactccgagaaggctgaagaatgtttttgtgttcttaaatccttcatctaagagaggatcatacgaaaacgttttggtgaaatccataggaacaaaatgaagatgacccggaattgtcagatttgcatccttcagcttattttttttgaattgctgtgtagccggatggtcaacctcgaaaacctgtaagctgttttctaattctggatgccgaaagcagaaggtatccagccccgctccaagaatgacatactgttttgcccccaggattaattcgttgtgcaagactttttcacaataagaagcacgtgctagtggcgtgggagacagctggatttgtgcaacccattttaatattttttcaggatcattttgaagacgttcggcgatctctttgttgaaaaacgatattccttgaatcatatttttactgatgtcgataaactctttttcgttaatgagatcttttgcgataaaatcatcaaaaataagagatgtgtcatatttgctgtgataagcacgggcaaacgctgaaatcaaagacgttaagctggactcatttttcctcatgaaatgatcctccacaaaaaataagattctcctggccaggagaatcttattatacatacaaatatattaatagtaaattttagcataaataaatttttttgtcaatgtttttgctcttaactggacgcgcgatccttcacatagccacgtgacctgtagcagaattcgtctatcaattatgtggactgaatcattagcttttataaaatgcgtacttgcggctgcatccctctttttgcaaatcaggagcggttttctgtctcatggcagcatcttttcgtcgtttcagctgagagagaaatcaagatatgtaacaataaaagcctgagggatctcaggcttttcctaatattacaatccaacagcattccaggctgcttcaactttagcggcatcagttgagccgtagaggtcacgggcagactgaatgagagctgccttggcatctttgaacgtggaagaaggcgtgaggtacgttgttaacgcacggtaatagatttgctgtgatttagatacaccaagttttgtgatggtgttgtaagcggctttgtttggaattccgctgtttgtgtgtacaccgccataatcgccttcatctgtgtttggaaggtttcggtaattggcgtaattgtcaggctggttgtattttgtagggttggacaggctgcgaagagcaggctggctgaccgtaatgtcttcaccgatgtcccagtcttctgtatcgttaaaatacccgaatacgtcagagaaagactcgtttaatgcacctggctgattttcataaatcaagttggctgtttcttgggtgacgccatgtgtcatttcatgcgctgtcacatctaatgagccggaaagcggagagaagaatgaaccgtcgccatcaccgtaaatcatctggtctcctgtccatgcagcgttattgtattgagtgccatagtgaacggaagaaacgattttactgcctttgttatcatagctgtttcgtttaaagtttgaataaaaataatcgtacactttaccgaggttatagtgtgcgtcaacggctgcccgctgtgatgaagatgtaaatgttttcgttgtgcttgagacaagcgttcccggaaggcggctttgtctgttttgcaaatcatatgtgatgatttgggtgcctgttggttttgaaagatctcttagaacatattttccgccttcataagagatgttcaaaggaacagttgcgccctttagagttgttccgcttccagtggcggcggcatgttctactttattttgctgttttaaaatgctgcctgtttcggcgtcaactaagacttcccagtttgcaggttcaggctcgacatagcgaatcgtcacgtcgtaagcaagacgatagctgccgtcttttgtttctatggctttcaattcggctttattgctgtttttggccgctccgttagaaacagcgtctggtgatttgccgatagctttgaaagcgagtgccagcgctttttcagaagagactttttggctgttatctgtttttgcagcagattgattgtgtaattcaccattgaccgcatagacattatcggatttatcgacgtgaacgatcacttgcgaatctttaattggcactccgttaacgacaggcgcatatcgaaagtgcttgtatccaagggcatcagtcgtgctttcaacaagcttcagccttttggaaggatcacctttaaaaatgttgctgttctttttcaaaaactgcttgacagccttgtcatttggtgcagagagttctgattgcgcaatcgcatttttggagaggaaatttgtttgattctctttaagctgatgaccttcagcagcctgaacacctggcaggctgattgataaactcataaacgaagcagcgacagcaacagacaatttcttacctaaacccacaataaatccccctttttgaaaatactgaaaactttatattgttatattaaactagcattctggaatactcaacaaaaactaacataactagacaaaattgatagtattgtcctgtgtttgtttttgttgaataatatcaagatgagtcaagtgtcatgtggtggttcattcaagagttatgttttttacatatcaaggggaagatgagatatttttgtttcatcttgaaactttttgaaaagtccgctgtctaaccgaatgaggccttaataagaagtaaaggattgttgttcgtgttggagttattcagtcattatgtattgcatttcgaacgttattttatattaagcagacaaagcaccctgctgattcaatggtcaattgttgttctggcgggtttatatcttttggggcatcatcccaaaataaaccggcagcgcacaatgttcatggcgggtgttatattgcggattgtgctgctggcgggagtgtctgttgaacttattcaccaagtgcaatcaacaaacttcaccagcgcttacttaagagaggacggaaatgaactgctgccgctgctgcattttttgttatacggatatgtgctgctaacggcttttcactatatgctgatgccgcgtgatcatggcggaaagggtaagttttatacgttcgaccttgccgttgtcagtttgccaatcgtacaaatgatttttagtttcttttcgtattggaaggaatacccggatgggatggagccgattgcattcgtgtttctgtttttcatcatcactcttcccattgcgttgaatgtagtgtttttcaagctgcattggagaacggataagatcttactaggcttattttatacgctgattatcggactgcttgtcttgctgcttgtgccatatcccaatcaaatctcaaaagattatggtgcagtaatgccatatacgatttatttggcaatggcgggatttttgatgagctatcatctgttccaaaagtcaggaaaggtttatgtgcgtgtgaataagtgggtgacgatggctgtcctggtgttttttgtcctgctgttaaatccgatatataacataggaacggctgctttcgctgtatcaaagccagcaaatgtccatgattcattcaattttgtcggggagcacatttcatcagaaaaagcggaacagatactaaagtcattttttcctacggatgaaacactttatttgcacgatacaaacatggatgtgcattatttctactcatttgaaagcaaaggttacaaagctgaggtagatgaagtatcgcagctgattcgtaattatgaatacttacaaaaagcacatgggaaaaagctaacgaatcaggagtacaagcgaaagtccatcgctttccttgagcgacacggacgtgtgttacataaggatcatatcgaaacaaaggtatctcaagaagacggccagacagtcgtacgtatttacctgaaaaaccagcttcataaaaaagatcatgctgatgatggcgcggtattttattgggaaaaggaaaccttaatggggtttagtgaagatccttcgatttatcagcttgactctcttctgcatgttcatataacggaacaagacattcacgacaaagtggaacaaatgtttacagcgctgaacatatcaaaacagccttatcagatcactgatattgaaagcgacagcctgcttggaagcatggtgagagttgaaacaaaaggtggaattgttttggaatttgagggcgaatcaggttgtttacatagtctttcgcttccgatgaaaaagaatatctcaatggctaacagccggctgcagcatcagatattatcgatcttcgatgctcgtggatcagaaaagaagaaaaaaagcagtcagggtgacatggtgatgtatactgattcttctaaaacatatgagtttgttgaagctcaaggtcagctaaacgtttatgtatacagcgatacacctgatcagtcattcccctatacgtatcgtaatggaacattggcttacgaaaaagtagcttctctatatcaggatgtcatttacaaaaagcgtatgcgtccgattatcgttcaaagaggggatgaacggcattatgcatggctgatcattattcagccgtttggttcaaatcgccatgatgcctatgtagtggatggagaaacacaagaggtgaaaagtctttatgaatcataaagaaaaagagtctgtttttgtagacttatacgacctgtataaagaaggagagctagaggatgaatcaatggaatggatgaaacagcatgaatccctatttcaaaagaatgcggaagacttaaagagtaaaacttgtttaaagagaagtcccggtgctgaagaagaaagccaaatcagatatatgaaagtatacctgtcttccatgtatatctgtttcattttattggccatttggatgacggtgtggttttacttttaatgaagcatagggattccattgaggacttgtatcggcagtattatcaagaaattttaaattatttattcagaaggactcatcatcttgaaacagccaaggacttagcgcaggacacgtttgtgaaagctcttaatggtctggcttcgtttagggggcattcttccatcagaacatggctctacaccattgcgcatcatacctttatcaattggtaccgaagggatgtcaaataccaatttactgaaatcagcaaaaatgaagggttaacgcaaacaacttatgagcagcctgaacagtatctgtcacgaacggtgaaaagcgaaacactgcggcaggagctcctgaagttaaaagatcagcatcaatccgttttgattttaagagaattccaagagctttcttatgaagaaatcgctgagatattgggatggagtctttctaaggtgaaaaccacattgcaccgggctagattagaacttaagaaacacatgacgaaaagtagagaggaggagcggatatgacctgctttctagtaagagacctgcttcctctgtatcttgaaggtgattgtaaaagagaaacggaacacgttatagaagagcatttaaaaatgtgcagcagctgcagagacatgtatgacacgatggctgagccatttgaattggaaagcgaacaggccgttgaggaggcttatctgccggaagaagaactgcgttttaaacagaggtactatggattactgatcatgaaagctgcctgctggtttggagcggtggttgccatgatgctgatcatcaaactgctgatataaaaaaagcgcttgtccgattccggcaagcgcttttttacattaagcctggggatgaatcatatcgtaaatagcggcaagctgttcttgtgacagggcactgaagagtttttcataaacgtcagcttgcagtggcgttgcacctgcttgtagcgctgcgtctttatcatagctgtacacatcatcttgtagcacaatggctgcttgaagaatgtgaatcttgagagaaacagcggagaaaaattgttcaagtgcaagtgcttctttttctgtgaagccaagttcaattgctttttctgtatcaaatttgtaatttccatcctcgagatacacacattgtgaaacaatgctgaaaaattctgatgtcgattcccagagtgtagcaattacctgagcctcttcttttgtcattcctaactcgacagctttttcgctgtcaaaataatatacaccgtcttgttcgtaaatacattgatttaatatatcaatgaatgtattgagatcttcgttagtgctcgcctgatgctggagttgaacagcagtgttatcaaccggtgtttttgcgctggctgcatcagaaccgaacgttaatagagcagctgaggtcattgcggcagtcgttaacatagctttttttacaaatgttttcttcatgtttcttctctcccttttatgaattgtgctacaaattccattatagggagtagtttccggtgaaggaataggcgctatggtattttatgtgtatcgttgccgaactactttttgaaggctgcacgtgtgatcgttagaacgattgtctatgtatgaaggctgttttgcatcttcctgactaagaaacaggggagataaggcttaaagaaatgaaaaacaccgctttctttgcggtgttttttgattacaatgtcgccggcggggcaatgcttttaatcaagcaagccttgttcgcgcattttcttttttaatgtaaatccgccgcccatgacagcgcaaacaagtacaatgctggcgataatgcctgcagggcttttttcagcgataaagacgccgatcagcataatgctgaaaaccgctgcaaatgcaaataatagtaaaagccaattcatttttttcataaattccatccccttttacgtcttatattaagtttacagaaaaacgtgacgcttttaaagaggatgtgtgatataatatgaaagttatctaatttttttaggagatgaaaaagtgaaacttcgaaatgatcttcgcaacatcgcgattattgcccacgttgaccatgggaaaacgactctagtcgatcagcttttacatcaggctggtacgttccgtgccaacgaacaggttgctgaacgcgcaatggactctaatgatcttgaacgcgaacgcggcattacaatattggcgaaaaatactgcgattaactataaagatacacgtatcaatattttggacacccctggacacgcagactttgggggagaagtagaacggattatgaaaatggttgacggcgtagtgcttgtcgttgacgcatatgaaggctgtatgcctcaaactcgttttgttctgaaaaaagctcttgagcaaaacctgaaccctgttgttgttgtaaacaaaattgaccgtgactttgctcgtccagaggaagttatcgatgaagttctggatctgttcattgagcttgatgccaatgaagagcagctcgagttcccagtggtatatgcttccgcgattaatggaacagcgagtcttgatccgaaacaacaggatgaaaacatggaagctttatatgaaaccattattaagcatgttccggcacctgttgataatgcagaggagccgcttcaattccaagttgcccttcttgactacaacgactatgtaggccgtatcggaatcggacgcgtattccgcggcacaatgaaagtcggacagcaggtttctcttatgaagcttgacggaacggcaaagtcattccgtgttacaaagatttttggtttccaaggcttaaagcgtgtggaaattgaagaagcaaaagcgggagacctagttgcggtttccgggatggaagatatcaacgttggtgaaacagtatgtcctgtagaccatcaagatccgcttccggtgcttcgcattgatgagccgacacttcaaatgacatttgtcgtgaataacagtccgtttgcaggccgtgaaggcaaatatgtaacggcccgcaaaatcgaagagcgtcttcaatcacagcttcagacggatgtgagcttgcgtgttgagccaactgcttctcctgatgcttgggttgtttcaggacgcggtgagctgcacttgtcaattttaattgaaaatatgcgtcgtgagggctatgagcttcaagtgtcaaaacctgaagttattatcaaagaaatcgacggcgtacgctgtgagcctgttgaacgtgtgcaaattgatgttcctgaagagcatactggctctgtcatggaatcaatgggtgcccgcaaaggcgaaatggttgatatgatcaacaacggaaacggccaagtccgtctcatctttacagttccttcccgcggattgatcggttactctacagaattcctatcattaacacgcggattcggtattttgaaccatacgtttgacagctaccagccgatgcaggcgggtcaagtcggcggacgccgtcaaggtgtacttgtgtcaatggaaaacggaaaagcaacatcatacggtattcaaggaattgaagaccgcggtgtcatcttcgttgagccgggtactgaagtatacgaaggaatgatcgttggagagcataaccgtgacaatgaccttgttgttaacgtcagcaaaatgaaacagcaaacaaacgtccgttccgcgacaaaggatcagacaactacaattaaaaaagcgcgcatcatgtctcttgaggagtctctagagtacttaaacgaagatgaatattgtgaagtaacacctgaatccatccgtttaagaaagaagatcctcaataagaacgaacgtgaaaaagcagctaaaaagaaaaaaacagcaggattgtcttaatctcgtgcagaatttgaaaagatagaacccgtacgtttacaggggagggaatctttttgaatgacgtaagcgaacgtctgtcgttcttcgccgctctatatcaagtagaccggcagcctgcggcaggcatgtggctgctgtacggcacgatttttgtgttggccgttattgtatttaagcttggatttgctaaacggcttcctgtattaaaatctgcagtggtgtatgtatttttggcgttgggctgcactgttttgacttttttaggggtgtttttgcccgtggcagaaggattggtcgtcgctgcgctgattttaatcacttacaaaatccggctgtatcagtcgaaaaaaggacagtctgcaaaatcataaaagactcagctgaaagctgagtcttttttgtgttctgtatggttaagcggccgctttattttttgactttttcttttttctgctgtcccgggtgaaaagtaaattttcccgttttcagccgttcctctgtttttttggcaatccgatcgtgacattcctggcacatatatgtatggatcgggcggtttcgaagccgtttcgcgatcagggtatcatcatcaattgtttcaattttatcgcaaatagaacatttgaccctcatcatatcacctctttcactaacatgtattatagcacggatcagaagctgtccaaaataagaaaaagctaaagcgcaaggctatagcttagtcattgttgttctttttcatatgatgatcagattgatcgttttgctccttctccatttcctgctgctgttttctatttaattggtcattttgctgctttgtttgcggttcgtcttcattgtcaatcacgtcgttaggcacttcgggaagcactcggccgacaattgcagctaattcatccagtatgcctgttaccggatggccctcgctgatttctctgctcatttcacgaaggcggctgaccgtatcgggatcagcaatgaccactgcgtttgcgccatatcgatcattctttagcgcctgagctacagaatatttaatggtttccactttgcttctgtccaaagtatcatcgacatcaatcccaacaacagcatagcctcccagcacaacggctgttgcatccttgacgtcggggtttttttcagcaacgctgacaagatgcttggcaatatcggttcttgttccattgtcttttgtttcttgagttgtgtcctttacgtgaatcggtttagtctcctgctgtcttgttgattctttttcaacattctgaccctgttttccttgttgataggcacaagcggacaggataagtgtcagctgtatgataatgaaaagaattcgcacttgcgggttccctccttaaaatgctttcattaattttattgttgaattaaccttctatctttatgcacaaaaacatatattttagcaggcattcacctttttcatcaaaagagaagcaggaagaactttgacccttatatcaggaggctgagacttgagtaaaatttatgtgttagatacgaatgtgttgttacaggatcctaacgcaatattttcttttgaagaaaatgaggttgtcatccctgctgtcgttttagaagaggttgattcaaaaaaacggtatatggacgaagttgggaggaatgcaaggcacgtatctaagctaatcgatgcgctaagacaaaagggcaggctgcatgagcatgtaccgcttgacaccggcggcacactgagaattgaactgaatcatcgttcgtttcaccagctgcaagagatctttattgaaaagacgaacgataatcgcatattagccgttgcgaaaaacttaagcctcgaggaagaaaccaaggaaaatggcaggccggttatcctcgtcagtaaggatgtactggtcagggttaaagccgacgcaatcggactgcttgctgaagatttcttgaatgaccgggttgtggacaatgatgaaatgtacagcggctataaagatttatatatcagccagcagctgttcagctctttttacggaaaaaatcaaatttcagtaaacgatgtgaaacagcatgcgttttatccgaatcagtttgctttaatgaaggatgagctaggaggatcctcctcggcagtcggaattgcagataaaaccggaacggtattaaaaagactcgtatttgatgatgaacatatatggggaatcaggccgaaaaatgtacagcagacaatggcattagagcttttgctgcgggaagatattccgcttgtcaccctgatcggcaaagcgggaaccggcaaaacgctcttagctttggcggcagggctattacagacagaagacttgggaatatataaaaagctggtcgtcgcaaggccgattgttcctgttggcaaggacatcgggtatttgccaggcgaaaaagaggaaaagctaaagccttggatgcagccgatttttgacaacttagagtttctgtttaatgcgaaaaaaccgggggagcttgatgctattttggcgggaattggctcaattcaggtagaggcgctgacttatatcagagggagaagcattccagatcaatttattatcattgatgaagcgcaaaatttgaccaggcatgaggtgaaaactttgctgacgagagtcggtgagggcagtaaaattgtcttaatgggtgaccctgaacaaattgatcacccatatttagacagtctgaacaatggtttagcctatgtggttgagcggtttaaaggacaacccatctcaggcagcgtgaagctgttaaaaggtgagagatcaggtctcgcccagctcgcagctgatttgctgtaacattaaatgatttcgatctcttttacgtcggtaatcggctgtttgtgatgaaccgggtcttcaaagtaaatatgcacggggccgccttcttgaatcggcttgcctgcctcactgaaatggacaatactgttcagagcggtttccagagaaacggcggcctttcccgaacttgtgacaaatacacattgcgtcgcagagctgttcggctcagcatttttcaggacagtcccaagtctcattgcgaaactgccgttcatcagtttttgcttctcatattgcttttccgtctttaatgtaggcggcgcaattcgcccctctctgatgacgcgttccggatcaaggtcggattcatccccggctgattgtaaatatatgtcttgactgtcccctttgcggtcaaacgaaaatttgcgatcatcaaaaatccatacgcttggatcaatggtaattgggtatgtaacattgccttttacttggataacgctcatgatatgacccccttctctcaaaattataaaagttttcgcatgaattgtcactttgtgtacaaattatgtgtattgaaatgctgagggaacgagggtgtttgcatggtatgccggcataatgatgagcttgaagccttagtgaaaaaggcgaaaaaagtaacggacaagggggagatagccagctatattcccgccttggcaaaagctgataaacacgacctgtcagtagcgatttattattccaataatgtttgtctgtcagcaggtgacgtagaaaaaacatttacgcttcaaagtatatcgaaagtcctttcccttgctttggtgttaatggaatacggcaaagataaggtcttcagttatgttggacaggagccgaccggtgatccgtttaactcaattatcaagctcgaaacggtgaatccgagcaagccgttaaaccctatgattaatgccggggcattggtagtgacaagtctgataagaggaagaacggtgaaagagagacttgattatttgctttcttttatcagaaggctgacaaacaaccaagagattacatactgccgggaagtggctgaatctgaatacagcacttcaatgattaatcgggcgatgtgttattatatgaagcagtacggcatttttgaagatgatgtagaggcagtaatggatttatacacgaagcaatgcgcgattgagatgaacagcttggatttagcgaaaatcggatctgtatttgcattgaacggcagacatccagagactggggagcaagtcatctcaaaagatgtcgctagaatttgcaaaacatttatggtgacgtgcggaatgtataatgcaagcggggaattcgcaattaaggtcggaattcctgcgaaaagcggcgtatccggcgggattatgggcatttcgccttacgatttcgggatcggcatattcggccccgcattagacgaaaaagggaacagcattgcaggtgtaaagcttttggaaataatgtctgagatgtacaggctgagtattttttaatttatgtcatatgcttaaatcctcttgcattttctgttgataccctttatgataaatagaagaattaggtactcgcctggggaacggagggatacttttggcttcagagatgatagttgaccatcggcaaaaagcttttgaactcttaaaagtggacgctgagaagattttgaagctgatccgagtacaaatggataacttaacgatgcctcaatgtcctctatatgaagaggttttagatactcaaatgttcgggctttcgagggaaatcgattttgctgtccgcctgggattggttgatgaaaaagacggtaaagaccttttatacacattggagcgcgaattgtctgctttgcatgacgcgtttacagctaaataaatgataaaactcaaacttattaacagtttgggtttttttataaccgctatttttctctcatctcataaaagacggtctttttttacacattccttccgaatcgtatagagattcttcgtctcgtttgataaattgtagtaaaataaaaaagataaatacataaaaaccatagataatggaagttagaagcagggaagaggatgttatgttaaaaaaaatgctaaaatcttatgattactcactgatattcgcaatcgttttattatgcggattcggtttagtgatggtatacagctcaagcatgattacggctgtctcccggtatggagtaagcagtaattttttcttcatgcggcagctgtttgctttaattgcgggtggcgctctatttattctcatggcgttgtttccttataaagcactggcccatcaaaagtttcagaaggggatactgcttgtatctgttcttgcgcttatctcactgtttgttttcgggcatgttgccggaaacgcgcagagctggtttaaaatcggcggaatgagtattcagccgggggagtttgtgaaactggtcgtgattttataccttgcagccgtatatgcaaaaaaacaaagttatatcgaccatctgttaacgggagtagcccctccggtagtcatgacgcttgtgatttgcgggttaattgccatgcagcctgatttcggtacagccatgattatagggttaattgcgacgtgcatgatcttgtgctccggtttcagcggaaagacgctggtgaggcttgtgatactgggcggaattgttttcattttagtcagcccgattatctatttgaatcaggacaaaattttaactgaaggccgtttagcgcgttttgagagtcttgaagacccatttaagtatgcaaattcatcaggtttgcaagtgatcaattcttattatgcgatcagctcaggcggcattttcggcctggggctcggtgaaagtatccaaaaatacggatatctgcctgaatcacacactgactttattatggctgtcattgctgaagagctcggcatttttggggtattgtttgtgattttcttattgggttttgtcgtcataaaaggtttttatattgccagaaaatgcgaggacccgtttggaagtcttctggcgatcggcatttcaagcatgattgccatccagtcgtttattaaccttggcggtgtcagcggattaattccgattacaggggttacgctgccatttatcagttacgggggctcttctttggtgctgcttctggggagtatggggatattagcgaatatcagcatgtttgtgaaatattcagagaataagaaaaagaaagagcccttggcgccgaagggaatgaaaaagaaacagctcaaaaaaactgtttatctgtaaaaaacaagtgtgtacaggggaaggatattccgctatgatagattatattccattcgggtaagggggagaaaagtttgtctcagcaatcgatacaaaaagtattagtagcaaacaggggagaaattgcaatccgaatattccgggcgtgtaccgagttgaatattcgtacagttgcggtctattcaaaagaagattccggttcctaccatcggtacaaagcggatgaagcatacttggtcggtgaagggaaaaaaccgattgatgcttacctggatattgaaggtatcattgatattgcgaaaagaaacaaagtcgatgcaattcatccgggatacggtttcttatctgaaaatattcattttgcgagacgatgtgaagaagaaggcatcgtattcatagggccaaaatccgagcatctcgatatgtttggtgacaaggtaaaagcgcgtgagcaggcagaaaaagcgggaatccccgtgattccgggaagcgacggtcctgccgaaacgcttgaagccgtcgaacaatttggacaagctaacggttatccgatcatcattaaagcctcgcttggcggcggcggccgcggtatgcggattgtcagatctgaaagtgaagtcaaagaagcatatgagcgtgctaaatcagaggcgaaagcagcctttggcaatgatgaagtttatgtagaaaaattaattgagaatccgaaacatattgaggttcaggtcattggagacaagcagggaaatgtcgtccatctttttgagagggattgttccgttcaaagacgccatcaaaaggtcattgaagtggcgccgagtgtctcgctgtcacctgaattaagggatcaaatttgtgaggcggcagttgcgcttgctaaaaatgtaaactatataaatgcggggacggtagaattccttgttgcaaacaacgagttctactttattgaagtaaatcctcgcgtacaagttgaacacacgataacagaaatgattactggtgtcgatattgttcaaactcagatccttgttgcccaagggcacagccttcacagcaaaaaagtaaatattcctgagcaaaaggacatttttacaatcggctatgccattcagtcacgggttacgactgaggatccgcaaaatgatttcatgcctgatacaggaaaaatcatggcttaccgctcaggcggcggttttggtgtccgtcttgataccggaaacagcttccagggcgccgtgatcacaccatactatgattcacttctcgttaagctttcaacttgggctttaacgtttgaacaggcagctgccaaaatggtacgaaaccttcaggagtttagaatcagaggcataaaaacgaacattccgttccttgagaacgttgcaaagcatgagaagttcctgacagggcaatatgatacgtctttcattgatacaactcctgaattatttaaattccctaaacaaaaagaccgcggaacgaaaatgctcacttacatcggcaatgtgacagtgaacggcttccccggaatcgggaaaaaagaaaaactggcgtttgacaaaccgttaagcgtaaaggtagacgttgatcagcagcctgccagaggaacaaagcaaattcttgatgaaaaaggtgcagaagggcttgcaaattgggttaaggagcagaaatctgtccttttaactgatacgacattcagagatgcccaccaatcgttattggcaactagaatcagatcgcatgatttgaaaaaaatcgcaaatccgacggctgcgttatggcctgaactattcagtatggaaatgtggggaggcgcgaccttcgatgtagcctaccgattcctgaaagaagatccgtggaagcgtttggaagatcttcgcaaagaagtgccgaataccttattccagatgctgcttcgctcatcaaatgcggtcggctatacgaattatccggacaatgtgattaaagaatttgtgaagcaatcagctcaatccggtattgatgtgtttcgtattttcgacagcttaaactgggtaaaagggatgacgttagccattgatgctgttagggataccggcaaagtggcagaagctgcgatttgttatacgggagatatccttgacaagaaccggacgaagtacgaccttgcatattatacatcgatggcgaaggagcttgaggcggccggagcccatattctcgggattaaagatatggcagggctgttaaaaccgcaggctgcatatgaactcgtttctgcgttgaaagaaacgatcgacattccggttcaccttcatacgcatgatacgagcggaaacggtatttatatgtatgcgaaagctgttgaagccggcgttgatatcatagacgtggcggtcagctcaatggcgggattaacgtcacagcctagcgcgagcggattttatcatgcgatggaaggcaacgaccgccgtccggaaatgaatgtccaaggcgttgaattgctgtcccaatattgggagtcggtgcgtaaatattatagtgaatttgaaagcggaatgaagtctccgcatactgaaatttatgaacacgaaatgccagggggccaatacagcaacctgcagcagcaggccaagggagtaggccttggcgaccgatggaacgaagtcaaggaaatgtacagacgcgtgaacgatatgttcggtgacatcgtcaaggtaacgccttcctcaaaagttgtcggagatatggcactttacatggtgcaaaacaatctgactgaaaaagacgtttacgaaaaaggcgaatctttagatttccctgattctgtcgtggagcttttcaaaggaaatatcggccagcctcatggcggattcccggaaaaactgcaaaagctaatcttaaaagggcaggagccgattacagtcagaccgggcgaactgcttgagccggtgtcatttgaagcgatcaaacaggaatttaaagagcagcataacttggaaatttcagatcaggatgctgtggcatatgccctttatcctaaagtcttcactgattatgtgaaaacgacagaaagctatggagacatctcggtattagatacaccgacattcttctacggcatgacattaggtgaagagatagaagttgaaattgagcgcggcaaaacgctgatcgttaagctgatttcaatcggtgagcctcagcctgatgccacccgcgtcgtttatttcgaactcaacgggcagccgcgtgaagtagtcattaaagatgaaagcattaagtcttccgttcaggaaaggctgaaagcagaccggacaaatccaagccacatcgcagcttccatgcctggaacagttattaaggtattggctgaagcaggcacaaaagtcaataaaggtgatcatttgatgattaatgaagcgatgaaaatggaaacaacggttcaggcgcctttctcaggaacaatcaagcaggttcatgtgaaaaatggtgagccgatccaaacgggagatctgctccttgaaattgaaaaagcataataaacaaagagtgtatatcatttgatatacactcttgtttttttatatagaaaatgtggagtgaaacagatggttagaagagatataaggggacttcagagattatacaatactgtcacaagcccaaaataaatagaggcttatacagccaatattttagatgctttgtagtatgccgtgcatatttctttaagcactatctgatttaaaaggctttaatacttatgttcgcgggctatagatgcatatgaaatttctataatcacgatgagaaaggggacagcccgaagtgagccgctcactgatcatcaagttcagcgaaggctggcgattgaaacaataaagcgccaaaacaagacctgaaaaaagaccaaagccgcctaaggctttggtctttagtccttatgattgactagattcgtaacggaaacgagcaatcaataataagaagtagcatagaacgccaaacagacaggcaataaagaacgagtgggcaagtgcaaagcccagagccagttcagagtatacgatcataatcccggacagtgcctgtaatgtaatgaaaataagacatgagatccatccccaaaagatctgtttttgatctttataggagataatagcatgaacagcggcaacaataatccatacaaataacagtaaggctgctgctctgtggcccatttgcacccattcatggaattgggtcggaagcccattgttcagcgggctgcacagcggcacatcaggacatgccagacttgattcagtgtgtcttacatatgcgcctgtatacacaacgatataggaatatattaaaattcctatcatgtgaaattgcatctttttgccgatttgaagcggcttaaccagtgttctgactgatttatcagcttcaaatatgagcaatgttaaaataagcactgaagcaaaagaaattaatgagatgccgaagtgaagcgccataatcagcgcgttcgaaccgaatacgacagccaatgcgccaagcaatgcctgaagaaataaaaagataattgacatgatcgcgagaaacgttgtttcacgaaaaatcggcgtgatttttctccatgaccaaaacgcaaggcttaacacaaggacaatagagattccgcttgcgaatcggtggctccattcaataattgaagccggattcagttcagggaaaaaacggccgtgacacagcggccactgtctgccgcatccttggccggaacctgtttttgtaacgagggcacccccgattaaaacaattagcatgacaaatgtcgtcagaacaccgagagcttttaatgctttattcatacaatattcaccttcttaacatactgctgcaattttatatacgttccaagtgtaagcgaatatgtgttttgtggcaattcccagagccttttgttcacaaaaatataatagaatgacggcttctggaaaatgtacacttgattattcatgccgggtctgatagaaataaggtaaacgcaatgccgatttggagattgccttcatctttggtaaaattcataaaaagttcacaaataaattcctgtttgtcgtttaatatttaataggatgtttttttacaagatgttatcttgtatgatagagttgcaggttattttattctcctgcgttaggtttgtaagggaggtttacgttatggctaactccagaatcttaaatgatacagctatagacggacaaattgaagaaacaacggcatggaaagattttctgtcccttattaaaatagggatcgtcaattctaacctcatcacgactttcactggaatgtggcttgcactgcatatatccggtttaagttttttaggcaatataaacaccgttcttcttacgttaatcgggtcttcactgattattgcgggctcctgcgcgatcaataactggtatgaccgggacattgaccatcttatggagcgtacgaaagtaagaccgacggttacgggtaaaattcagccgagtcaggcgttatggtctggaattttgctggttgctttaggattgatcatgctgctgatgacaactgtcatggctgctgttatcggttttatcggagtctttacgtatgttgtattgtacacaatgtggacgaaacgccgctatacgattaacacagtagtaggaagcgtttccggtgcagtgccgccgcttattggatggacggcagtggaagggaatatcggtgtcgtagcatgggtgttattcatgattttatttatttggcagattcctcacttcttagcattggctattaagaaaacagaggattacagagctgcaaatattccgatgcttcctgtcgtatacggatttgaagtgacaaaaagacaaattattgtgtgggttgcgtgcctgatgccgcttccgtttttccttggtagcctgggtcttccgattgtcattctcggcttgctgttaaatatcggctggctgattcttggcttaatgggattccgctccaagaatatcatgaagtgggcaacacaaatgttcgtttactcgcttaactacatgacaatctatttcgttgccatggttgtcttgacgcttttctaaaaaatagatatgatgcttgttttatcgcttcaaaataaacgatgacaactagtaaatgccgccttgacctcttgtttaatcaggcggctttacttttatacatagatggcattttgagtaaaaaaactcataatttaagagaagaggaaatgtaagtgctttattggtgataggttggatggcgatagatttcgatccgctttccgcctttgtattgaccagaaaaggggttgggtgaaatggtaaagcattggcgtcttattttattattagccttagtgccgcttctattaagcggatgtggaaaaccttttttatccacgctcaagcctgctggcgaggtggctgataaacagtatgacctgacagtgctcagcacattgattatggtggttgttgttgcagtagtatctgttatcttcttttatgtgattgtgagattcagaagatcacgggtcggtgagaacacgataccgaaacaggtagaggggaataaatttttagaaatcacatggaccgtgatcccgattttgctgctcattattcttgtgattcctgttgtattatatacgctggagctagcggacacatcaccaatggataaaaaaggccgcaaagctgaggatgctcttgtagtcaatgttagggcaaatttatactggtgggagtttgagtaccctgattacggcattatcacaagccaggagctgattgtaccgacagatcagcgtgtatattttaatttaaaagcctctgatgtaaaacattccttctggattccttcagttggaggaaaacttgatacgaatacggataatgaaaataagttcttcctgacatttgattcaaaacgaagcaaagaggcaggagatatgttttttgggaagtgtgcagagctttgcggcccttcacatgcgctgatggattttaaggtgaagacgatgtctgcaaaagaatttcagggctggacaaaagaaatgaagaactataagtctacagcagagagcgatttggctaagcagggtgaagaactgtttaaagagaaaaactgcctgagctgccatgcggtagagccgaatgataagcgtgcagaagccgctagaacggcacctaacttggcgaccttcggtgaaaggacaaaagtggcaggggtgaaagaggccaacaaagaaaatgtgaaggcttggctgaaggaccctgacagtataaagccggggaacaaaatgacaggcacatatccaaagctctcagacagcgaaacagatgcgctttatgaatacttaaaaggcttaaaagcggaaagcaagtagggaagaaagggagatattgggggaggtcacatatgttgaatgcgcttacagaaaagcggacgcgcggatctatgctttgggattatttgacgacggtggaccataaaaaaatcgcgattctttatttagtggcagggggattcttctttcttgtcgggggaattgaagcgatgtttatcagaattcagcttgcaaagccggaaaatgcgtttctcagtgctcaagcgtacaatgaagtaatgactatgcacggaacgacgatgatctttctggctgcgatgccgctcttatttgccttgatgaatgcggttgtgcctttgcagatcggggctcgggacgtttcgtttccatttttaaacgcgcttggtttttggctcttctttttcgggggcattttcttaaatctaagctggtttttgggcggagcgccagatgcgggctggacatcatatgcctcactttcgcttcattctaaagggcacggcatagactttttcgtcctcggactccaaatatcggggctcgggacgctgatagccgggattaactttttggccacgattatcaacatgagggctccgggcatgacgtatatgaggctgcctttgtttacatggacgacatttgtggcctcggcattgattttgttcgcgtttccgccgcttacggttggattggctctcatgatgctggatcggctgttcggaaccaatttctttaatccggagcttggcggaaatacggtcatttgggaacatttattttggatttttggccacccggaggtttatatcctaattttgcctgcattcggtattttttctgaggtcatccctgtgttcgccagaaagcgtttgtttggctattcttcaatggtttttgcaatcgtgctcattggctttctgggctttatggtttgggtgcaccacatgttcacgactggtctcggcccgattgcaaatgcgatttttgcggttgcaacaatggctatcgcgattccgaccgggattaagatttttaactggctgttgacgatttggggaggaaatgtgaagtatacaaccgctatgctgtatgctgtctcatttattccatcctttgtgctcggcggtgtgacgggagtcatgctggcagctgctgcggctgattatcagtttcatgatacgtattttgtggttgcgcacttccactacgtcattattggcggcgttgtattcggccttttagccggtgttcatttctggtggccgaaaatgttcggtaaaattctgcatgaaacgatggggaaaatttcatttgtattgttttttatcggctttcacctcacgtttttcattcagcattttgtcggcttaatggggatgccgcgccgggtttatacgtttttgccaggacagggtctggaaaccggcaacttgatcagtacaatcggggcgttttttatggcggcagctgttattcttctgctggtcaatgtcatatggacatcggtaaaaggtgaatatgtaggtgctgatccatggcatgacggacgtacgctggaatggaccgtttcttcaccgccgccggagtataactttaaacagcttccttttgtcagaggacttgatccgctttggatcgagaagcaggcagggcacaaatcaatgacgccggcggaaccggttgatgatattcatatgccaaacggctcaatcctgccgctcatcatttccttcggcctttttgttgcagcgttcgggctgctgtacagaagtgattacgcttggggtctgccggtgatctttatcgggctcggcatcacatttattacgatgctgcttcgttcagtaattgatgatcacggctatcatattcataaagaggaactgccgaacgatgataaaggggtgaaggcataatgcaagttcaagaaaaattcaccgcagaaacctttccagcttctcctgaaaaagtaaccctggaagggaaaaataaatttttaggcttttggctttttcttggcggagagactgttctgtttgcgtctctcttcgccacgtttcttgcgcttcggaattcaaatgccggtgatccgcctacgacggaaatgttcgatgtgacacttgtattcattgccacaatgcttctattaacgagcagtttaacgagtgtgtacgcgatgtaccacatgaagaacttttccttcggcaagatgcagctttggctgggaattacgattttattgggggcgggctttttaggactggaaatctatgagttcaagcattacacccatgaatttggctttactatcacaagctctgcccttggttctgcgttttacacgcttgtcggtacacacggcgcccacgtggcatttgggcttatgtggatcagcacgcttatgatccgcaatgccaagagagggctgaatctgtatacggcgcctaagttttacgttgccagcctttattggcactttattgatgtcgtgtgggtcttcatctttaccgttgtatatttaatggggatggtgggataaacatggtcgataaaaaaagcagagggcatatcaatagcgaccttgaatttaagaaaaaaaagcatgcccgggagatgaaatatcaagtcctgtcttttggtttaatgatcggtcttacgattgttgcatttctgactgtggccacggacggtgtcggcagctggtttacgattcctttcattattttgctagctgcaattcaagtcatctttcagctgtattatttcatgcatatgaatcagaaagggcatgaggcgccggcactgtttttgtattcaggggtgtttgtcgcgtttatcactgtgcttgcgtttgtgacaattatatggtggtaatttgaacagccgccggaggtgaagaaatgaatcagttggagatatttgggtttcgcgcgatgtggagcccttatcttttttgtatcctgttaggcattacggcgctttatctctatttttacaggcgaatgtcttcaaagccgaatcgaataactggtaaagagatggtgtgctttctgtcggcgatgctgtttttatatgcagccgagggaagcccggttgatctgctcggacatattatgttcagtgcgcatatggtgcagatggccgtcctgtatttggttgtcccgccgcttttgatcgcgggaattcctgcatggctctgggaaaaaatcattttcaggccttcaatcaaaccggttttttcctttttttcgacgcctttaattgctttgcttttgtttaacggcattttttctttatatcatgtaccgcttatatttgatactgtcaaaaccgatccattttaccatacattaatcacttggcttatctttgtgcttgcgttcttcatgtggtggccgcttgttcataaggttgagcgtctacggcagctcagcggcttgatgaagctgggttatattatggcggacggtatgctactcacacctgcttgcgccttgatcatgttcagcggtgcaccgttatacgccacctatacagatccggctttatgggctgaggcaatgaggctttgcgtgccagcggatatgatggggcaggtcccattaacagggccagagatgttgaatacactgcctttgttagaggatcagcagctcggagcagtcatgatgaaaatcattcaggaaattgtgtacggtacttttttggccgttatttttttccaatgggtgaagaaagaaagggaaaaggacgggcaggaggagccgccgtatattcagcagacgatatcataaaaggtacagcgaaatatgctgtaccttttcgttacatttgaactgtttttaacatgttggctatgtcctgaatcagtgccttgctttttgtcacaacctgtacgggaaactcttccgtttctccatattctactccatgcgggtagtaatgctttcctaggagaggggacattaattgaatcacggcgcgcccgcttccgacatcgccttctgccgcaataccttgtatccgcaggtaaaacgtaccctcaatcgtcgaaaacttcttgtcataggtgactctctcgtaatcccattgacccgctctaatgagacctttgctttccattaagtcgtctagccagctgagctcagccttaaccccttcaagtccgctttcagtaaacttcaacactgacccctccttataaaaattacctttcctgacaatcatagtatgaaagcgttaaactttcaatgaatcttcttcttttgaaagtatgcaaaaattaaattttgacgacaatagcactagactaaaggaggttaaacggatgacaaaaataaaagatctgatgacagccgacttgcaatattgcacggtattagataatgtatatgaagctgcagtaaagatgaaggacgcaaatgtaggagcgattccggtagttgatgaggacggggaaacattggtcggcatcgtaaccgaccgcgatctcgtattaagaggaatcgccatcaaaaaaccgaactcgcaaaaaatcactgacgcgatgactgaaaaacctgtcagtgtggaggaagatgcttcagtcgatgaggttcttcatttgatggcatcgcatcagctcagaaggataccagttacaaaaaataaaaaactgactggaattgtcacgcttggtgatctttctttatctgagcaaacgaatgaacgtgccggcagcgccttatcggatatttccgaaggtgataatagagaagaaggcttttttcattaacacataaatctttgacatgttaaataggctgtattgtaatgggatgtaaacaagagattgtgaatcgccacgggggtgatagattgaaaaatatattgagagcaatggttatccttttgattatctgcggaacttatgttctgtttattcaatatggatctgttcctgaaaagaaatcaaatgacagcgagcctcaggtgtcgaatgaggaagcgcaaagcggcaaacgaatacatatgccgacttcagggttattgtccttcatgggcaagcccgccgatgaagtaacgaaaaagcttggggaacctgaacgtattgacccttcggcttatgattacgattggtgggtatacaatcaaggtaaggatcaatatatccaaatcggggtattaaacaataaagtggtcacattattcgcgtcgggtaatgatattaacgccaagcctttcaaaattggagaatcaactggcgaagtatttaagaccacccaggtggcaccatttgtgaatgtagagtataaaggaaattcctatcggtttgaattttctgaagaagatatcaatacaagaccgactgtaaaggtaggaaagatgtatgtccagctgtatatggacaaatttgaggggaagctatccagcattagggcgtttgatgcgcaaacctttgtaaagcaaagaccttatgaggtagtgtaccgcggggaattaattaaaccgaaagccgtttcagatgagaaatggaaaaagatccaaacaacgagcgaaaagcaaatccttgatttgacgaatgtcatacgcgttaaacatggacttgcgaagcttgaatgggatcagccaacggcggaggtggcgtttggacatagtgaggatatgaaggaaaataattatttctcccatgtctctaaaaaatacggctcgctgaaagaccgcttagaagaagggcatgttgactttcagcaagcgggagaaaatatcgcatacaattatgtggacggtccggccgctgtagaaggctggctgaatagcgaaggccatcgaaaagcgttgctgaattcagattatacgcatcttggtgtcggagtagaccggaaatattacacccaaaattttattaagcgatggtaatgaaagccgcggacgaatggttcccggctttttctatttccatacaagctggtctgaatgaatgtgctgatagcttacagataaggccgtttcccattccttcagtcaggctttttcaccagtgtatagggatatcgctaaaaattcatttgggaatgaatataggcgaacacaatgcccgacaaaacgatacattgtagtaggtaacgattttcggagggggtgaggattgtggcgaatcaacatgccaatcattcaatcaatgactttaaacaattcgtcaaaaagcatcccaagctgataaaagaagtgcgcaaagaacaaagaagctggcaggacgtatatgaaaattgggtcctcttcggggagagcgacccgatttgggatccgtatcgggaaccggaagaagcttctgaagctgtgcctgaaacaccgcaaaaaaatgattttgtctcgaaaatggtgacagcggtgaaaaagatggatgtcaatcaaatgaacgaacaaatcaataaaatgagccagtcgatctcatcgttgcaaagccttcttaatacattttccggaagcggacagaagcattctcagccaggctctggacagcatcctttttcttttcgaaaggattaaaaaaggggagctcatatgcgcaaagaggttcaggaatatattttagcaaacgaagaacggaaacgattcatcagagaacagccgatatggtaccgcaggctttcaagaaaaccggatgatctgtcctcctttcagcttgaaatgatgaatttttatgaaaaaaccattccgcatcgggtgaatcagtttacgaacgggattcaaatggcgcaaatgatgatgcaaatgtttcaagcgatgcggacaaaagattaaaaggccccgaaaaagggtcttttttcatgcggacataaggttttgtatacggctgcggttaagcattttccaattggctggtttcatggtaaactaacaactggaggtgcatgttatgtatgcgacgatggaatccgtgcggcttcaaagtgaagctcagcagcttgccgagatgattctgcagtcggagacggctgagaactaccgcaattgttacaagcgtctccaggaagatgaagaggcaggtcggattattcgttcttttatcaaaataaaagagcagtatgaggatgtacagcgttttggcaaatatcatcctgactatagagaaatatcccggaaaatgagggagatcaaacgtgagctggacctgaacgataaggtggctgacttcaagagagctgaaaatgagctccagtccattcttgatgaggtcagcgttgagattgggacagctgtttcggagcatgtgaaagttccgactgggaacccttattttgacggtttgtcttcatgcggaggcggctgcagttcaggcggaagctgcggatgtaaagtgtcctgacgagactggccgtctcgtcttttacatataagagaaaacaggcaggtgattgtattggagaataggcgccagggcatggttgtgtatctgcactccctaaagcagagcaaaatgctgaggaagttcgggaatgtgcactatgtatcaaaacgattaaaatatgtcgtactgtactgtgatatgaaccaaattgaaaaaacaatggacaagattgcgtcttactcatttgtgaaaaaagtggagccttcttataaaccgtttttaaaattggaattcgagtcaaagcttgataaggcaaaagaatacgattataaaatcggcatatagctataaaaaaatccccgcaggcatctgcggggtccttctattccttaatatgttaaggagaaggcaaagggagaggagaaaccggaggaagaacttatggggaaacgtaagtcttctccgcggttggcaacaacatcctctagatgctgttgcttatagtatggacaaggatcatgctgcctatacacctgtttatcaagattagcgttcattgtttggaagaatgctttatgttaagataggattgatttttttctatgtacatagcggcgtccggccgaataaagaaacaaaatagcttttagaaaaagtggtgtggaacatgagagtaatttctggatcaaaaaaaggccgttcactaaaggctgtacccggaacatcaacaagaccgacaaccgacaaagtgaaggaatccattttcaatatgatcggcccttattttgacgggggcatgggacttgacttattcgcagggagcggaggtcttggaatcgaagcgctttcacgcgggtttgagcattgtatattcgttgaccgtgattttaaagcgattcaaacggtaaaatctaatttgaaaacgctggagcttacaaaacatgcacaggtataccgcaatgatgcggaacgtgctttgcacgctgctgctaaaagagaaagcggctttcgcggaatttttctcgatccgccgtataaggaacaaaagctgaaagcacttttaacgctgattgacgaatatcaaatgctggaagaagacggctttatcgtcgctgagcatgacagagaggtcgagcttcccgaaaccgtaggagatcttgtgatgacaagaaaagaaacctatgggttaacaggtgtggcgatttataaaaagagggggtagtgaggtggcgagtatagctgtctgtcccggcagttttgatccggtgacctacgggcatctggacatcatcaaacgcggggcgcatatttttgaacaagtgtatgtatgtgtgctgaataattcttcaaaaaagcctttgttcagtgtggaagaacggtgtgagcttctgagagaagtgacaaaagacattccgaacataacagttgaaacatcgcaaggcctgttaattgattatgcaaaaagaaaaaatgcgaaagcgattttaagaggcttgagagctgtatctgattttgaatacgagatgcaggggacgtcagtaaaccgtgtgcttgatgaatccatcgagacattttttatgatgacaaacaatcaatattcgtttctaagttcaagcatcgtaaaagaagtggcgagatacaacggctcggtatcagagtttgtaccgccggaagtagagctggcgcttcagcaaaaattcagacaaggatgagggttttgactcatcctttttttgttccgtttgtcagtctgtaagaaaaaatgataatgtacgtaaacagcgcgcatagtgtgacagcaggtccgatctgcacaagcagattccagccatttataaaggccgttggcatgtcactgctgttaagagatttaaatacatactgatatggatcatgccatgccgtgtaaagaggtttccataaaagcatgacgaagacagcggcataaacgccctgcagcaaacgtgcgataaagaatggtttaaatctaatgtcggtttccgataaaatacctgccacctgagcttgtacggaaaagccgctaaacccaagaataaagctgacgataatggctttttgcagaagagaaacatctgtctcgctgacaagcttgctgcctaatgtaatttcaaacatccctgataaaagcggaatgtccaattgagtcggaagctgaaacaaagtcagtgctccttttgtgaaaacagacaaaacatcagtcagctggaccactgacaacagccgattgaagacagaaaataaaataataaagccgcctaccataagaagcgtttgaacagaagacgtcacggcgtcgcctaaaattttacctaagggccgtttttctgcaagtctggcggtatgaagagcgtgtaaagcatctttgactgaagggaaaggtatcgttttctttcttctgagatgctgctcttccttgcggccataggagcgcattgttaaaccgacggcaagattccccaaatagtgtgcagaagctaataaaatgcctagtgatgcgttttgaaagaaaccgacggcaacagcgccgaaaataaagagcgggtttgaagaattggtaaacgacgcgagccgttctgcctctactcttgaaatctgattttcctgccgcagacgggcagtgagttttgcgcccgctgggtttcctgatgccattcccatagcaagaacgaagccgccgacacccggcacgcgaaagatcggccgcataaaaggctcaagcaaaacaccgacaaaccgcacaatgccaaagccgattaagagttcggacagaataaaaaatggcagcaatgacggaaacacaacctcccaccacatagacagcccggttttagaggcttcgaatgaggcctgtggatgtgagatgacagtcgctgttaaaaaaagaaaaaacgaggcaatcaaaagtgtattaatcttcgacaagttcattcttacctccccgatgctaaaaatgcccaatgacatgtatatcatgataaaataatgtatgatgtaaaacggccaagcagtacctgtcctcttgattctttgtactaatatacgagcataggggttcagtttagaccatagaattcggtatacagggaattcaggcaggaggttaacgctttggccaaacctaaaatcgggttagcgttaggatcgggaggggccagagggcttgctcatctcggtgtgctttccagtttacataagcaccaaattgaagtggatatgattgcaggaagcagcatgggcgctttggtgggcagtttttatgccgccggacatgacgtggcaacgatgaaaaaagtagccaaagcctttaaacgaaggctttatgctgattatacggtgccgaagctcggttttttaaaaggtgaccgcgtcagacagcttgtgcatgcttatacattcggaaaaccgattgaagagctccaaatcccgctgggcattgttgcgtgtgatctacagacgggagaaaagattgtgttccgaaaaggatcagtgtcagatgcagtgagggccagcatcagcatcccgggtatctttattccgcagcggctggacggacgccttcttgtagacggcgcggtcgtcgatcgaattccggtttctgttgtgaaagacatgggagctgatattatcatcgcttcggatgtttccagggttcgaaaaactgaaacagcagtgcatatttttgatgtgattatgcaaagtatggatatactgcaaaatgaattagtgcggcatcaaacaattgccgcagatatcatgattcgcccttcccttgaaacatacagctcaagctcgtttgccaatattgaagaaatgatatcggcaggcgaagaggcgacaaaccgaatgatcagcaagataagaaaagaaatagagaattgggagggctcataatttgctacgtaaaaaacattttagctggatgctcgtcatcctcatactgatcgcctttttatcatttataaaacttccatactatattacaaaaccgggagaagcgacagagcttgcttcattgataaaagtggagggaggctacccggaaaaaggaagtctgtccttaatgactgttaaagtgggaccggctaatccgtttacatatgtgtgggcaaagatgcacccttattatgaaattgttcctgatgagagcattaaggaggaaggcgagtcagataaggagtatatgaaaagacagctccaaatgatgaaaagctcgcaagaaaatgcggttatagccgcctatcaaaaggcaggaaaaaaagtcagctattcctttaacggcatatacgcaagctctgttgtagaaaacatgccggcaaaagggaaaatagaagtcggtgataaaatcatcagcgcagacggcaaaaactatcagtctgctgaaaagctgattgattatatcagcagcaaaaaagcgggagataaagtcacgttaaagatcgaaagagaagaaaaagaaaagcgtgtcacccttacgttaaaacaatttcctgatgagccggatcgggcaggaatcggagtttcgctttatacagacagaaacgtgaaggtagagcctgatattgattttgaaatcgaaaatattggcggcccgtcagcagggttaatgatgtcccttgaaatctataatcagctgacaaaaccagacgaaacaaaaggctacgatattgcgggaacaggtaccattgatgttgacggaaaagtaggcccgatcggcggcattgatcaaaaagtcgtcgccgcagacaaagccggaaaagatattttcttcgcgccaaatcaaaacggcgccagcaattccgattataagaacgcagtaaaaacagcaaaagatattgattcaaatatgaagattgtgcctgttgataccatgcaggatgcgattgattatttgaataagctgaaagcgaaaagcacctgattctcaggtgctttttctatacatttaaaaagtgttgttcatcttcgtcatatcgaatcggtgcatgtccgtattcctgtaggtcaaactcagttctcagcggctcttctatcggcaggctgtaaatcctgcttgcttttacgtccagatcgagagctggatgggagaaagaggacagtttgctgacaagcggaacagacagtgcttttttcttttcggataaataagcctgtccttttttcgtcatgccgagaagcctgatatacggcgccttatcgttgtcaagcagcttttgcatatcctgtttttttgttctggttaaaatgtgtgtattcatccgctggagccttgtccacgtatagcgttttgttttcagcagttccataaattcctgataggagctggattttctgatcgaacgaataattctgtgctctaaaccttcctccacctcgtatacttgctgtaattcccgtgccgttacagttgaaaggctgtattttaagtaagaaaagtagctttcaggtgtatgccacaatccgaaagatttgcggtaagctgctaattcacgtgcagatgcagcagggagaaaacgaaggcaggcttcgagattctggccaatcatcgcttttctaatgcttgtggcacttgctatatggttttcgccttcagggagatcggcatcatgatagtccgaagagattcgtgccgtagtataaggtttcataggatatcccccggttagaatcgaggtcacatactggtatcccaaaatgttatttggttttgacaagtcaagtgcactttcagtatgcaaaatggagctgaaggcgatagccgccgctgctgggtaactggccccctttttaagttcttctttaattcggtcattcaatatatgtttatgctcatcaataagctgtgctgtttctaaaaaaggcttgatatccccattttcactcccgaaaaacagcgcctcacattcaagttcgttcaggatggaaacactgccgcgtgcaaaaatgtctgctttttgcacggcataaagataaggcagctcaatgacaagatcaactccgctttgcagcgccatttttgttcgggcccattttgatacaacagcgggctccccgcgctgtaaaaaatgcccgctcatgaccgcgacagccgtgtcacatccggtttgccgctttgctgtttgggcatgataaaggtgaccgttatgaaagggattatattcaaccaccaatccgacagctttcatattttttccgcctttcttgctatgtttaaaaacgtatggtacatttgcaaatgaaaactcttacgccttatttttgttttaagtgtatgcatagcatattccgctgtcaacgatacttcaatggcagcattatgctgtaaagaaaaaatattgacaaaaacaatcttaaaagctataatcatgtttgttgctttcctgaggtgatacaaatgaaatggacgatttatcagctgcatcaaatgccaaaacaaagttttgagtttgatgaaacagttgagttaaatgagctgacaaagctgaattctgacattcgccgcatttctcccgtccgggtgaagggcagagcggatatcaaatccaaacaggtttcgtttgattttacaatttcaggcgaaatgattttgccatgctcaagaacactcgttgatgtcccgtatccatttgaaatttcaacaaaagaactgtttatatttcatcacacggatgatatagaagatgatgacgttcacattgttgaggacgatactatcgacttaactccgatcgtgaaagaagaaattcttttagaaatccctatgcaaatcttttgtgaatctgaacaagaaaaaggagctgctcctcaagaaggaaaggattggcaagtcatttcggaagaagacaagaagaatcaagttgatccgagacttgcagccctcgaaaagctcttaaaacaagatgatgaatcttaactctttaaggaggtgggaataatggctgtaccttttagaagaacttctaaaatgaagaaaagattgcgccgtacacatttcaaacttaatgtacctggtatgacagaatgtccgtcatgcggagagatgaagttgtctcaccgtgtatgcaaagcatgcggatcatacaacggcaaagacataaatgtaaaaagtaactaataagaaaagcgcggggtgaaaagccctgcgctttttctttttctcttcctgtcagcttgcggaaaatttgtgagtgcaaatagtctatctaatctattaccggcatatgtatgagataaataagctgacatggagggagattgaatttgaccattacaagacaagatgcttggactcaggatgaggatttgctgctggcagaagtggtgcttcgtcatattcgagagggaggaacacagctttcagcctttgaggaggttggaagggcgctgaccagaaccgcggcagcctgtggtttcaggtggaactcgtatgtgagaaaacaataccagtcaggtatagagcttgcaaaaaagcaaaggaaagaactgagaaagcaaatcggtgttcattcggtcaatatgccgaattccatgaagcagactgcctcggcatcgtcagaaggaaaacgagatttgtccattcaggatgtcattcaatttctcgaacaattcaaagaagcaccgtctgcacaagaatttcagcttgaaagggaaaaattgaaggagcaaatccaatcgctgcaaaaagagcttgaggatttgcggagtgaaaatcagacattgcggaatcagctagagatgacagaagaggattacaaggcactgatcgatatcatggatcgggccagaaaaatggttgtttcgaaggaagacggaagaatgaaaaaagcggctcaagaaacgtaaagaaacgcctgaaatgaaccggccctatagtaagaataggccggttgttttgatttctatgcagactctcccggtgtcatttcatgatccatatcaggatgccagatgagcgggttttcccctttgtcccgcgccatatcatacttaacagttttaaagttcattttgttccaaaattccgctgatttcattctcggatttgtccggatcggcattttgaatgattttgcaaattcaaccaaggctctcccgtatcccctgttctggtagcccggaagaacctcaagcttccacagctccaaataatcctggcggttgtcaaaatagggattcgatttgccgttaacttgatacagactcattcgtgctacaagtttatcgccaaaataaatcccgtaaaaaggcgaagtgctgtcattttcaataatattatcctgaagttcttcaagcattgaaagctcctgaatgccgtattctttgaatttcttgaattcttccagcgttttatagttgataagcagacgttctacctttgtcaaacaaatctccccctttgttgtttctacatatattgtaaacgctttatttaaaaaatccaaatatttaaactttaattttaagcacatgggatctttgagaagtaatttcttcttacttctgctatgataatacgtaaatgctaaattgggtgtgacatcatgaaaattggaattatcggcggaggctccgtcggtcttttatgcgcctattatttgtcactttatcacgacgtgactgttgtgacgaggcggcaagaacaggcggcggccattcagtctgaaggaatccggctttataaaggcggggaggaattcagggctgattgcagtgcggacacgagtatcaattcggactttgacctgcttgtcgtgacagtgaagcagcatcagcttcaatctgttttttcgtcgcttgaacggatcgggaaaacgaatatattatttttgcaaaacggcatggggcatatccacgacctaaaagactggcacgttggccattccatttatgttggaatcgttgagcacggagctgtaagaaaatcggatacagctgttgatcatacaggcctaggtgcgataaaatggagcgcgttcgacgatgctgaaccagactggctgaacatcttgtttcagcataaccattcggattttccgatttattatgagacggattggtaccgtctgctgacgggcaagctgattgtaaatgcgtgtattaatcctttaactgcgttattgcaggtaaaaaatggagaactgctgacaacgccagcttatctggcttttatgaagctggtatttcaggaggcatgccgcattttaaaacttgaaaacgaagaaaaggcttgggagcgggttcaggccgtttgtgggcaaacgaaagagaatcgttcatccatgctggttgacgtcattggaggccggcagacggaagctgacgccattatcggatacttattgaaggaagcaagtcttcaaggtcttgatgcagtccacctagagtttttatatggcagcatcaaagcattggagcgaaatacaaacaaagtcttttgagctttttcggtaacatgctatactcatttcggatcactaactatttattggagaaaggaagttctagaagatgcagctaactgaactttccatcaaaaatcagaatgtgtttgtacagcactatatagatggcaaagaagaaatgtcttcttttttgattacagtattcatcataaggacatgtggcgcgaaagaatggaagacttatcttcccggtttttcgcaagagaggaattggcggcgtacttaacctcttaccataataaattcggttcaagtgcgatgcagtctgccattgagaagctgaaggacccgtcaagtgccgcagtagtcggcggacagcaggcaggacttttaacaggaccgctttacaccatacataaaattatttcaatcattgttttagcaaagcaacaagaaaaggaactgcaagtgcctgtcataccaatcttctgggtggctggagaagaccacgatttggatgagattaattttgttcacacatctgaagagaatggacctgtgaaaaaaaagctgcctcagtcttattggaagaaatcatcagcagcgagtacatcgcttgatcaggaaaagtgtgccgcgtggatagatgatgtttttgccgcttttgaagaaacagaccatacgaatacacttctcgacaatgtgaaacgatgtttaagggaatctgttacgtttactgacttctttgaactgctgattgcggatttgttccaagaagagggcttagttttattaaattctggagatccggggattaaaaagctggaaacggccatgttccaaaagattcttcgagaaaatgatgaactcgcccgcgctgtatcagatcagcaggccttcatgcgtcaagcaggctacaaaccgattatcgagtccggaaaagagcaggcgaatctgttttatgaatacgaagaagagcgttttttaattgaaaaagacaacggccgatttgtcatcaaagagcttgatctaggatggacgagggatgaacttcatacacatatggaagaacatccagagcgtttcagcaacaatgttgtaacgagaccgttaatgcaggaatttctcattccgactttagcatttattgcagggcctggggaaatcaattattggggcgagctcaaacaggcttttgcggtgatgggcttcaaaatgcctcctgtcatgccaaggctgaacattacgatacttgagcggcatattgagaaaaaactggctgaacggaatatctcattacaagacgcgattgagcgcggaacggagaatcaaagagagacatacttcgagcgccagattccggaagagtttacggcggtgatggatcaggcgaaaagccaaattgaagcgattcacaaaacggtccggcaggaggcgttaaaggttgatcaaagcatggaacctttactcctgaaaaatgccgcttttattcaggatcagcttcaattcttagagcgcacggtgacgaagcgaattgaagaaaaagaaggctacgtcttgaaggattatgaaagaattcaaaatagcattaagccgcttcttgcgccgcaagaacggatttggaatatcatgtattatttgaacaggtacggtccaaaattcttcacgacattcaagaatctgccattttcttttcaaaatcaacatcaagttgtcaaactttgaaataaagttttaaagaaccctgaatagttcagggtttttttttatgggtaaacagtgtaaaatgaagttgtggagcgaagtggtgaatagtggtgagttaaggagagaaagtggggcaagagatcatgtttatgggtgaatatcagcataccatcgatgcgaaaggccgcatgatcgtacccgctaaattcagagaaggcctaggtgagcaatttgtgctgactagaggacttgaccaatgtctcttcggctaccctatgcacgaatggaaacaaattgaagaaaaactaaaagctcttcctctcacaaagaaagatgcccgtgcgtttacccgtttcttcttttcaggggcgactgaatgcgaactggacaagcaaggcagggtaaatatcgcatcatctctattgaattacgccaaactggaaaaagaatgtgttgttatcggggtttctaatcgaattgaattgtggagtaaagtaatttgggaacaatacacagaagagcaagaagattcatttgctgaaattgctgaaaacatgattgggtttgatatataatgattcttcgtgtataacactctaaaagcaatttcaattcatcctgataaaaggtgggaccaacacaatatgtttcaacacaagacagtacttcttcgtgaaaccgtagacggactcaatattaagccggacggtacatatgtagactgcacactcggcggagctgggcacagtacatacttattgcagcagttatccgagaaggggcgtttaatcgcttttgaccaagatgatacggcattacagcatgctaaagaagtgttgtccgactataaaggacagctcattctgattaaaagcaatttcaggtatttaaaagaatgtttgaatgaacaaggcattacagaagtagacggtattttatttgatttaggggtgtcctctccgcagctggatacaccggagcgcggattcagttaccatcatgacgcaccgttggacatgaggatggaccagtcggctacgcttacggcgaaagaagtcgttaatgagtggcgctatgaggatctcgtccgtattttctttaaatacggagaagagaagttcagtaaacagatcgccagaaaaattgaggaggcaagaatgaagtctcctattcaaactacgggccaactggtcgatctaataaaagacgcgattcccgctccagcgagaaggagcggcggacatcccgctaaacgcgtgtttcaggcaatcagaattgccgtaaacgatgaacttagggtgtttgaagaagctttggagcaggcaattgaggttctgaagccagggggcagggtatcagtcattaccttccactcgctagaagacagaatttgcaaaaccacttttaaagaaaagtcgtcgcttccagaacttcctccgggacttcctgttataccggaagagtttgaaccggagctgaagctcatcacacgaaaaccgattacggcaactcaagaagagcttgaagagaacaaccgggctcgttctgccaagcttcggattgctgaaaaaagaaaataacgaaacgcgaacgcaaaattaaaaggaggtcatcagcctatgagcaatttagcttaccaaccagagaaacagcagcggcatgcgatcagtcctgagaaaaaagtgattgtcaagaaaagggcttccattactctcggagaaaaagtgcttcttgtcctctttgctgcggcggtgctcagcgtatcgcttttgatcgtatcgaaggcgtatgcggcatatcaaaccaatattgaggtgcaaaagcttgaggagcaaatttcatccgaaaataagcaaattggtgacctcgaaaaaagcgttgctgatttaagcaaaccgcagcgcattatggacattgcgaaaaagaacggcttgaatttaaaagataaaaaagtgaaaaacatacaggaatgattcaaatgccaaaaaagaataaatttatgaatagaggagcagcgattctaagtatttgtttcgctctctttttctttgtcatcctggggagaatggcatatattcaaataaccggaaaagcgaacggcgaagtgcttgcgacaaaagcgacagagcagcatgaaaagaaacggaccatcgaagcgagccgcggctcgattttagaccgaaaaggaaaagtcattgcagaggacacagcgacgtataaactgattgcgattctcgataaaaaaatgaccactgatgtcaagcatcctcagcatgttgtaaacaaagaaaaaacggcagaagcattgtctaaagtgataaacttggacaaggccgacatccttgatatcttaaataaggaggatgcaaaacaagtcgagtttggctcagctggccgggatattacgtattcgcaaaagcaaaaaatcgaaaagctgaaactcccgggcatttcatttttacgggatacaaaacgctattatccaaacggtgtttttgcatccaatttaatcggctatgccgaggttgatcaagacacaaatgaaatttccggcgcgatggggttagaaaaagtgctggataagtatttgaaggagcgggacggatatgtgacatatgaaagcgacaaatccggctgggagctcccgaacagcaaaaataaaattacagcgccaaaaaatggtgacaatgtatatttaaccattgaccagaaaattcaaacctttttggaagacagcatgacaaaagtggcgcaaaagtataatccgaaaaaaatcatggccgcagttgtcgatccgaaaacaggcaaagtccttgccatgggacagcgaccaagctttgatccgaacaagcgggatgtgacaaactactataatgatttgatttcatatgcgtatgaacccggatcaacgatgaagatatttacactcgctgctgcgatgcaggaaaacgtgtttaatgcgaacgaaaaatataaatcaggtacgtttgaagttggcggggaacctgtcagggaccataatagaggtataggctgggggccgacaacctatcatgacggcgtccttagatcgtcaaatgttgcatttgcgaaactggcgaaagaaaagctgggatatgaccgtcttaatcaatatttacacaaattcaatttttatcaaaaaacaggtattgatttgccaggagaagtctctagcaaaatcaactttaaatatgaatttgataaggcgtcaaccgcatacggacaagcgtctgcagtcacaccaattcagcagcttcaggccgcaacggcaattgcgaatgacggcaaaatgatgaaaccttatgtgattgaccatatcgttgatcccgataaagataaaaccatctatcaaaataagccagaatcagccggaaccccaatttctgcaagcacagcgaaaaaggtgcgggatatattgggagaagttgttacgtcgaaaatcggaacagggcaagcctataaaatcgaaggatttgatgttgccgggaaaacaggtactgcgcaaatagccggtaaaggcggatatctagacggaacagatgactatatcttttcgtttatgggtatggcaccaaaagatgatcctgagcttttaatttatgttgctgtacagcagccgcaactcaaagcaggacaaagcagttcagatccggtatcagaaatcttcaacccgacaatgaaaaacagcctgcactacctgaacattgaaccaactgaaaaatctgactcagataaggaagaaacaaaagcgcagacaatgcctgatttaacagatcaaacggtagctgctgctcaaaagaaagcaaaagaggagaatctcacaccaattgtcatcggcagtgatgtcgctgtaaaagaacagtatccgaaagcggatgaggaagttctcaccaatcaaaaggtcttcctgaaaacgggcggcaaaatcaaaatgcctgatatgacaggctggtcgagaagagaggttctgcagtacggcgagctcgcgggaattcatattgaagtaaacgggcaaggctacgctgtcagccaaagtgctaagaaagacaaagaaatcaaagacaaaaccgtaatcaaggttaagtttaaaaatcctgattaaaaagaaagcttgcgttatgcaggctttctttttttatgccttcagaggagcatcgttctacctgtccaatttcaggcataaaatgaaacaagcctaaataaggagtgaacggtctcttgcgcgtctcgaatgtaacggttagaaaacgtttattatttgttttgctttttggcgtgatcgtgtttctgatcattgatacaaggctggggtatgttcagtttgtgatgggcgaaaaactgacttcgctggcgaaagattcctggagccggaacttgccgtttgagccggagagaggcgagatactggatcggaatggtgtgaagctcgcaacaaacaaaagtgcgccgaccgtattcgtcgtgccgcgccaagttcagaatccgatgaaaacgagcaagcagcttgcggcggtgctcaatatgtcagaagaaaaagtatataaacatgtgacaaaaaaagcgtcaatcgaaaagatcactcctgaagggagaaaaatttcaaatgagaaggcgaaggaaattaaagcgcttgatttaaaaggtgtgtatgttgcggaggacagtatccgtcattacccgttcggcagctttttatctcatgtgcttggatttgcaggaattgacaaccaaggactccttggattggaagcctattacgacgatgatttaaaaggggaaaaaggttctgtcaagttttatacagatgccaagggtaaaaaaatgcctgatgaagcggatgactatacgccgcctaaggatgggcttgatatgaagctgacggttgattcaaaggttcagacgataatggaaagagagcttgataacgctgaggccaaatatcatccggacggcatgattgccgtagccatgaatccgaaaaacggagaaattttggggatgtctagcaggcctgacttcgaccctgctgattaccaatctgttgatccgtccgtctacaaccgaaatctgccagtatggagcacgtatgaaccgggatctacctttaaaattattacacttgcagcagcccttgaagagcaaaaagtaaatttgaaacgggatcaattttatgataaagggcatgcggaagtggacggagcgagactgcggtgctggaaaagaggcgggcacgggctgcagacgtatctggaagttgtgcagaactcctgcaacccggggtttgttgaattaggcgagcgcttaggaaaggaaaagcttttcaaatatatcaaagactttggttttggacaaaaaacggggattgatctccaaggcgagggaacaggcatcttattcccgcttgagagagtaggcccggtggagcaagcaactacggctttcggacagggagtatccgtcacgccgattcagcaggttgcagcagtctccgccgctgtaaacggaggaacgctctacacaccttatattgcaaaggaatggatcgatcctgttacgaagaaaacggtcaaaaaacaatcaccaatcgcaaagaaacaagtcatttctgaggaaacatccaaacaaatccgctatgctctagaaagcgtcgtcgcagaaggaaccggccgcaatgcatttgtagaaggatatcgtgtcggaggaaaaacgggaactgcacaaaaggttaaagatggaaaataccttgaaaacaaccatattgtatcatttatcggtttcgcgccagctgatgatccgagtctagtcgtctacgttgcggtggataacccgaaaggcacgattcaatttgggggaacggttgcagcgcctattgtcggaaatattatgagagacagtctgccggaacttggtgtgaagccccggaaaaatcaaatcgagaaaaaataccaatggaacgacacaaaaacaatagaagttccgaatgttgtagggatgtctgtctcagatcttgagtcactattggtgaatctcaatgtggatgcttccgggaaagggagcaaaatcgttaaacaatcgccagctgccggaacgaaagtaaaagaaggctcaaagatacgcgtgtatttgactgaagaagatgaaaaggaggcagccgattgattcgggctgcctattcttttattgcagaaaaaatgctgatatctttcaagattagctggatgtatccttttatttacgctaaaatatgaactgtatgcttaaaatcattaccacatcatttgatgtgacttcaatgataaaaagaacgaattagaatgttgagaggtttgatacgatgaaacttacaaagctgcttacatacttaacaaccgaaccttctgtaaacgactcacaagaccctgaaataacttcaattgagatggactccagggaagtaaagaaagggagtctttttgtatgtgtaaaagggtatacggtggatggccacgattttgcgcaaaaagcagtagaaaacggtgcagcggctattgtggcagaaagagaggtcgatgtgaatgttcctgttattattgtccggcagtcacttcgcgcgctcagcgttttgtctgatgcgttttacggacagccgacgaagaagcttcagctgattgggataacagggacaaacggcaaaacatcaacgacccacatggtcgatgagattctgaaaaaagcgggaaaacgcacaggcttgatcggtacaatgtacatgaaaatcggagacgaaacacttcctgttaaaaacacgactccggaaagcgtcacgctgcagaaaacgtttaagaaaatgaatgacaagcatgttgacactgcaatcatggaggtttcttcccacgctttgtctttaggacgcgtccatggctgtgattatgatattgccgtgtttacgaatttaacacaggaccatctggactatcataaaacgatggatgagtaccggcatgcaaaaagcttgctcttttcccagcttggcggggctttcaaccatgaacatccaaagcgtgccgtcctgaatgctgacgatgaggcgagcgcttattttgaaaaggtaacagctgcgcatatctctacatacggaattaaaaacgatgctgatgtgatggcgaagaacatcagtatcactgcacagggcacaagctttgatctcgtgacaaacaaaggcacgaagcacatcacgatgtctctcgtcggacaatttaatgtgtataacgtgctggccgctgttgcgacatgtattgcagcaggcataccgtttgaaatcatcactgaagctgttgaagaattgcatggtgtaagaggccgttttgaattggtcaatcagcagcaggagtttccagtcattgtagactacgcgcacacaccggacagccttgaaaatgtgctggagacatgcagagacatgacggaaggaaagctatttgtcgttgtcggctgcggaggagacagagataagacgaagcgcccgaaaatggctaaaattgctgtggagctggctgacgagccgattttcacgtcagataacccgagaagcgaagatcctcgcgcgattttaagagatatggaagccggagtagagaacgcatactatcacagtattgcaaaccgcgagcaggcgatctttttcgcaattgccaatgccaaaaaaggcgacgttgtcctcattgcgggaaaaggacatgaaacctatcagcagatcggaaatgaaactttcgattttgatgatgctgaagtagcggcgagagccattgttgaactcaataagaataagacgaattcataggaaagagatgttactgaataatggagcttgaaaagatttttcatatggaaaaaaatcatgaatatgataactacgtatgtcgtttgaaagaaacaggaggagaaaaggacaatgcttgagcaagtcattctgtttacaattttaatggggtttttaattagtgttctgctctctccgattcttattccgtttttaagaagattaaaattcggccagagtattagagaagaaggaccgaaatcacatcagaaaaaatcagggacaccgacaatgggcggggtcatgatcatactttctatcatagtgacaacaattgttatgacacagaagttttcagaaataagccccgaaatggtgctgcttctgtttgttacgctaggctacggtttgcttggctttttagatgattacatcaaggttgtcatgaagcgcaatcttggattgacatcaaagcaaaagctgatcggacaaattattattgcagttgtattttacgccgtgtatcattactacaattttgcgacggatattcgcattcctggaactgacttatcatttgatcttggctgggcttactttatccttgtgctctttatgcttgtcggcggatcaaacgcagttaacctgactgacggccttgacgggttattgtccggtactgcggcgattgcctttggcgcctttgccattctggcatggaatcagtctcaatatgacgtagcgattttctcagttgccgttgtcggtgcagttctgggcttccttgtatttaatgctcatccggccaaagtttttatgggagatacgggatcgcttgcattgggaggagccatcgttaccattgccattttaacgaaattagagatcctgctggttatcatcggcggtgtattcgttatcgagacattatctgttattttgcaggtcatcagctttaaaacgacaggtaaacgaatctttaaaatgagtccgcttcatcaccattatgagcttgtcggctggtctgaatggagagtagtcgtgacgttttgggctgcgggacttttgcttgccgttttaggaatttacatcgaggtgtggttataagtggaaaatgatcaatttttacagaaacagcattttttaatccttgggcttgcgaaaagcggatatgcggcggcctccattcttcatgaaaaaggcatttatgttgcagtcaatgaccaaaagccttttgaagaaaatgaaccggcacaaaagctttctgaaaaaggaatcgaagttgtttgcggagagcatccagtttctctgttcgatcagcatcaaatcacgattctgatcaaaaacccgggaattccttatgaaaatattatggttcaggaagcggagaaacgaggcattccggtttggacggaaattgagctcgcttactacctgaccagcgccaagtttatcgggattaccggatcgaacggtaaaacgaccacgacaacgctaatttacgaaatgctcaaagctgactcgcaaaaagcactgattgccggaaacatcggcacagtcgcaagtgaggttgcctatcatgctgatggagatgaatggatcgttaccgaactgtcttcgtttcagctgatgggaacacacgctttcagaccggaaatcagcctgattttaaatgtatttgacgcccatctggattatcaccatacgcgcgaaaactatgaaaaagcgaaacagaaagtgtaccttcatcagactgcttcagataaagccattgtcaaccaggatgatgaaaccgtcgtgcgtcttgctgaagccggaaaagccgaaatcgtcccgttttcagtcagcaaaacgcttgaacagggcgcatatgtaaaagacagtatgattatgtttaacggcgaagccattcttcctctggaagaggttgtactgcccggtgctcataacctggagaacattttagcagctattgcagttgtgaaaacggcaggagcatccaatgaggcggttaaaaaggtgctgacaagctttactggtgtgaagcaccgcctccaatatgtcacaactgtgaatggccgcaaattttataacgacagtaaagcaacaaacattctggcgacaagcaaggcgctttcagcttttgacaagccggtcattctgcttgcgggcggactggatcgcggaaatggttttgatgacttgaaaccttatatgaagcatgtcaaagcagtgcttacatttggccagacggcgccaaaactcgagaaactcggcaatgaactgggaatacaacatgtcaaacgtgtcgataatgttgaacaagcagtatctgcggcgtttgcgctctcaaatgaaggagatgtcatcctgctgtcacccgcgtgtgcgagctgggatcaattcaaaacatttgaagaacgcggtgacatgtttatagatgccgtgcatatgcttaagtaagggcttgtcttgaagtaaatcggcagccctaatgactttaagcttggggtgtcgattgctttgactactaaaaaaacatcgcctgatttgttattggtcatcattacgttattattattaacaatcggattaattatggtgtacagtgcgagtgcggtatgggcggattataaatttgacgactcattctttttcgcgaaacggcagcttttgtttgcgggaatcggcgtcattgctatgttttttatcatgaatgtcgattattggacttggaggacatggtccaaattgctgatggttatctgctttttccttctggtgcttgttttgataccgggcgtcggaatggtgcggaacggttcaagaagctggatcggagtcggagcattcagcatacagccttcagagtttatgaagcttgcgatgattgcattccttgctaaatttctctctgaaaaacaaaaaaacatcacatcgttcagacgggggttcgtccctgcacttggcatcgtgttttcagcatttttgattatcatgtgccagcctgacctcggaacggggacagtaatggtcggaacttgtattgtcatgatttttgtagccggcgcgcggatcgcccatttcgtctttctcggactgatcggcctcagcggatttgtcgggctcgtactatcagctccatatcggattaagcggattacctcatacttaaatccatgggaagacccgctcggaagcggatttcagatcattcaatcgctttatgcagtggggcccggtgggttgttcggaatggggctcggacaaagcagacagaagttcttttatctgcctgagccgcaaacagactttattttcgccatcttgtcagaggagctgggctttatcgggggaacacttattttgctcctcttcagtgtcctgctgtggagaggaatcagaattgcgcttggtgcgcctgatctgtacggaagctttgtcgcagtcggcattatttcaatgattgccattcaagtcatgatcaatatcggcgtagtcacgggcctgattcctgtaacaggcatcacgctcccgtttctgagctacggaggctcttcattgactctaatgctgatggcagttggtgtgctgctgaatgtaagccgctactcgaggtattaacgaatgtatgtccatgcttcctgtctaacatgaagcttggaaacaattgatgcgataaccctgtccaacaaaacagggttatcgttatgttatagagaaacttagactgggggaaaagaaatgcgaattgcaataagcggaggcggtacagggggacatatttatcctgcgcttgcttttattaaagaagtgcaaagacgtcatcctaatgtggaatttttatatatcggaacagaaaacgggctggagaaaaaaattgttgagcgggagaatataccgtttcgttcaattgaaattacaggatttaaaagaaaattgtcatttgaaaatgtcaagactgtgatgcgttttctgaagggcgtcaaaaagagtaaatcgtatttagcggaatttaagcccgatgccgtaattggaacgggcggttatgtatgcgggccggttgtctatgccgctgcgaaaatgggaattccgactattgtccatgaacaaaacagcctgccgggcatcacgaataagtttctttcaaaatatgttaataaagtagcgatttgttttgaagaagcgaaatcacattttcctagcgagaaagttgtatttacgggaaacccgagagcctctgaagtcgtctcaataaagacgggacgatcaatggctgaatttgggctttctgaagacaaaaaaacggtcttaattttcggcggaagccgaggcgctgcaccgattaaccgcgctgtcattgacatgcaggatgcgctgaaaacaagagactatcaagtgctgtatatcaccggtgaagttcactatgaaaaagtaatgaatgagctgaaaagcaagggtgccgctgataatatggtcacaaagccgtttcttcatcaaatgcctgagtatttaaaggccattgatgtcattgtggccagagccggtgcgacaacgattgccgaaattactgctctcggaatcccaagtgttctgatcccaagtccatatgtgacagcgaatcaccaggaggtcaatgcgagatctcttggccagcataatgcggcgattgtactgaaagaaacagagctcagcggggagaagctgattgaagcgctagaccggattgtactgaatgagcaaacgttaaaggaaatgagcgaacgaacaaagtcactcggtgttcctgacgcggctgcccgtttatacagcgtactcgaggaattaaaaaaatagtagaaaagcaaatggaatgcggaggtttacgatggagaaagtgatacaggaattaaaagaacgcgaagtcggcaaggttcttgcaaatgaaccgctcgcgaatcatacaacgatgaaaatcggcggacctgcggatgtattggtcattccaagcagtatagatgctgttaaagacatcatggacgtgattaaaaaatatgatgtgaagtggacagtcatcggccgcggatcaaatcttcttgttttagatgaaggaattagaggcgtagtgatcaagctgggggcgggtcttgaccatttggagcttgaaggggaacaagtaacagtcggaggcggttattcagtggtccgccttgctacatcattgagcaaaaaaggcctgtccggtttggaatttgctgccggcattccaggatcagtcggcggagcggtttatatgaatgccggcgctcacggttctgatatgagcgagatcctcgtcaaagcgcatattttgtttgaagacggaacgattgagtggctgacaaatgagcagatggatttcagctacaggacatctgtactgcaaaagaaacgcccgggcgtttgccttgaagctgttttgcagctggagcagaaggataaggaatcaatcgttcagcaaatgcaaagcaataaagactatagaaaaaatacacagccgtattcaagcccttgtgcgggaagcatattcagaaatccgcttccgaatcatgccgggaaccttgtagaaaaagcaggcttgaaaggatatcaaatcggcggtgcaaagatatcggagatgcacggaaacttcatcgtcaatgcgggaggagcatcagcaaaagatgtgcttgatctcattgaccatgtgaaaaagacaatccgtgaaaaatacgagattgatatgcacacagaggttgaaatcatcggcggaaatcgctgattcaagttctgactgaagctgttcatatgatatactgtaagcaaacgacaaacggcatcatagtatgccgtttgttttggaatagacagacttttaacagctgtttcatttgaatgaggtgaacaggcaatgaacccgggtcaagaccgagaaaaaatcgttaacattgaagagcggatccctaaaattaaagagcagaggaaacaaaaggcaaaccgccgtctcatttcatttattatgctcttttttattatggtgctgatcattgtgtacctgcaaacaccaatcagtaaagtatcaacaatctctgttacagggaatgaaaatgtatcaaaaaaggaaattatcgacctttccgatattaacagcggagatactgagttttggagtttggacaagcaaaaaacagaaaagaagattcagcaaaataaattagtgaaaaaagcggagatcagcaaatcgcttcctaataaaatcaacattgcaatcgaagaatataaagcgattgcttatttagaaaaagacgatgtgtactatgaagtgcttgaaaacggctcagttctgccaaacgaagtaacgccggatgatgccggaccgattttagtgaattggacaaacgcgaagaagcggtctcaaatggccaagcagctcgatgcgttgtcaaattcgttaaaacagtcgatttcagagatttattatacgcctgtaaaaatggatgaaaaccgtattaagttgtacatgaacgacggttatgttgtcactgcatctattaaaacgtttgcagaccgaatgaagacgtatccttctatcatttctcagctaagcagcaataaaaaaggaatcattcatttagaagttgccacctattttgaagagtttgggaaaaacgataaggctgctaaaaaggaagatgaaaattgaggggcaaatcagcagtccttctttccttgattatgcttatcgcaggctttttgatttcattttcttttcaaatgacaaaagaaaacaacaaaagcgcggctgagacggaagagtggaaaaaagaatatgcgctgagagatgaacttctgaaacaagagaaagaaaataagaagcttgaaaaagaattatatcaaaagcaaaacaaagtccgccaggcggaaaataagctgaagaaagagaagtcggaatactataatgtcctcgaagatacagaaaaatacaggatgtatattggggaagtcggtgtgcagggagaaggcgttgaggtgacattggaagatgcgtcatacataccggaaggggagaatgtgaatagttacatcgttcacgaaagccatatcttccaagtagtaaacgaaatgtatatctcaggagcggcagctgtcgccgttaatggacagcgtttgacgcatgattcgtatatcaaatgcaatggtcctgtggtaacggtagacggggtgcagcatcccgctccatttacggtatccgctattggagatccagatgtcctgctgccctcgttaaatatcgctggaggcctaattgatcagctgtcaatggatcatatttctgtgtcggcagaaaaagagaaaaacgtacaaatgaaaccgattctgaaaacgaaggaatgactgaaaaagcgggtgaaatagattgaaaataaagcgttccttcataagcatcagtgtgcttatggtcatcttcggcctgatgatatctgttcagtttaattcgttaaagcaccccaaagtccgggatacaagagatatgtgggatattagggaagagctgacatcagagcagaagaagcaggaaaagctgctgtctgaaataaacaaatatgacaaacttctgaatagctattcgcaaacgaaagaaatgacaaaagaaaccgcgctaaataataccttgcaatccttaaaaaaaacagccggcatgaccgatataacaggtagcggaattgtcattacgatttccccgcttttttctgaaagcttaacaggagagccggtcgaaaatccgcctccggatttgctgaaaaagctgattaatgaactcaactcctacggtgcagagcatatctcgattaacgagcgaagagttgtgaatcatacagttatcagagatataaacggcactacaaaaatagacggatacgcccttgacgattatcctttaacagtaaaagtgcttgccaaagatccggacatgttacacagcggagtgaaggggtcaggccttgaggatctttttgcatctgaaaatttagcattaaaagccggtaaatctgaaagcaaactaacattaaaagcatatgacagaccactggacgtacaacagctgaaactgcttaaagactgaaaaggaggagaattgtcatgtggctgcccgtgttgggactggtgctcggaatagcgattggactaatgacaaacttaacgataccgagtgaatactcaaactatttatcgcttgcggtgcttgccgcacttgatacattaatcggcggaatcagagcgcatttacaaggtacatatgatgaaatggtatttgtttccggtttcttttttaatattatattggcaataagtttagcttttctgggagtccatcttggtgtagacttgtatttagcaggtatattcgcatttggagtcagattatttcagaatatagccgttatcagaagaaatctactaacaaagtggactctttctaaaaaaaataaaaaaaatgtgatataaaagaggatatacataggatataacgaatattttcaataaacataaaatgtgaaaagcacataaaaatattctgttgttattttttgttacacacttgtaaagccacattcattgtattgttgttccgcaaataatagaatagaaatgatcgaaatgtgaggaggtgccatagaatgaacaacaatgaactttacgtcagtcttgacatcggtacgtccaatacaaaagtgatcgtcggagaaatgacagatgattcccttaatattatcggtgtgggaaatgtaccgtctgaagggttgaaaaaaggctcaatcgttgatatagatgagaccgttcattctataagaaaagcgtttgaccaagctgaaagaatggtaggttttccgcttagaaaagctattgtcggcgttaatggaaattatatcaatattcaagatacaaacggtgttgtagcagtttccagtgaaaataaagaaattcaggttgaagatgtacgccgtgtcatggaggcggcacaggttgtttcagtaccgcacgaacagctgattgttgacgtcattcctaaacagtttatcgtagatggaagagatgaaatcaccgacccgaaaaaaatgctgggtgtgcgtttagaagtagagggcaccttgatcaccggttcaaaaacaatcttacataacttactccgctgcgttgaaagagctggtattgaaataactgatatttgccttcagccgctggcagccggttctgctgcattatcaaaggacgagaaaaaccttggtgtggctctcattgatatagggggagggtcaacaaccattgccgtattccagaacggacatctcacttctacccgtgtcattcctctcggaggcgaaaatatcaccaaagatatctccatcggattgagaacgtcaacagaagaagcagaacgcgtgaaaaagcaatttggacatgcctactatgacgaagcctcggaagatgaaatatttgaggtaaccgttataggcaccaatcaaaaacaaacatttacacagcaagaagcagcgaatatcattgaagcgagagtagaagaaattcttgaaattgtttcagaagagcttcgcagtatgggaattaccgatctgccgggaggcttcgtgctgacaggaggacaagcagctatgccgggtgtcatgtctttggcgcaggatgtgctgcaaaacaatgtcagagtggcaagcccgaattatatcggtgtaagagatcctcaatatatgacgggagtgggcctgatccaattcgcctgccggaatgcaagaatccaaggcagaaaaataggctttaagatgcctgaagaagcgatacaggaaatcgcagtctcatcatctgaggaacaagagcagcatcatcaccaaaatgaggtgcagcagcggccaaaaggaaaacaaaaaacacaagccgaacataataaacagagcaaaatgaaaaaactattaagcatgttttgggaatagatagatagtcattcggcagattaggaggatttagcatgttggagttcgaaacaaacatagacggcttagcatcaattaaagtaatcggagtaggaggcggtggtaacaacgccgttaaccgaatgattgaaaatgaagtgcaaggagtagagtatatcgcggtaaacacggacgctcaagctcttaacctgtcaaaagcagaagtgaaaatgcaaatcggcgcaaagctgactagaggattgggagcaggtgcgaatccggaagttgggaaaaaagccgctgaagaaagcaaagagcagattgaagaagcacttaaaggtgctgacatggtattcgtgacagctggtatgggcggcggaacaggaacaggtgccgcaccggttatcgcacaaatcgcgaaagacttaggcgcattaactgtcggcgttgtgacaagaccgtttaccttcgaaggacgcaaaagacagcttcaggctgcaggcggaatctcggcaatgaaagaagcggtggatacactgatcgtgatcccgaacgaccgtatccttgaaattgttgataaaaacacaccgatgcttgaagcattccgtgaagcggataacgtacttcgccaaggggttcaaggtatttctgacttgattgctacacctggtcttatcaaccttgactttgctgatgtgaaaacaatcatgtcaaacaaaggatctgctttgatgggtatcggtattgctactggggaaaatcgcgcggcagaggcagcaaaaaaagcaatttccagcccgcttcttgaagcggccattgacggtgcgcaaggtgtcctcatgaacatcactgggggaactaacctcagcctatatgaggttcaggaagcagcagacattgtcgcttcggcatctgatcaagacgtaaacatgattttcggttctgttattaatgaaaatctaaaagatgagattgtggtgacagtgattgcaaccggctttatcgaacaagagaaggacgtgacgaagcctcagcgtccaagcttaaatcaaagcatcaaaacacacaaccaaagtgttccgaagcgtgagccaaaacgtgaggagcctcagcagcagaatacagtaagccgtcatacttcacagccggctgatgatacgcttgacatcccgacattcttaagaaaccgtaataaacgcggctaatgtaaaggacaaaatcgttttcgattttgtccttttttgtttttctcttcacactttccttcttataaagtctttttccctattgcttccttcgcttagtaacaaaacagataattagacctatttatttttgtgacatttctatcattttcatatatatggaaattgaatgacatgaaacgacaatatctgtaattcagattgtctacagttaatatacagcgatgttctgacaaaccattcattattaaaaggagggacgacactttttttaaaaagcatgttgaaaaagggggatgaaaatgaagaaaaaaacgaaaaacagactcatcagctctgttttaagtacagttgtcatcagttcactgctgtttccgggagcagccggggcaagcagtaaagtcacctcaccttctgttaaaaaggagcttcaatctgcggaatccattcaaaacaagatttcgagttcattaaagaaaagctttaaaaagaaagaaaaaacgacttttctgattaaatttaaagatcaggctaacacagaaaaagcggcaaaagcggctgttaaaaaagcgaaatcgaagaagctgtctgccgctaagacggaatatcaaaagcgttctgctgttgtgtcatctttaaaagtcacagccgatgaatcccagcaagatgtcctaaaatatttgaacgcccagaaagataaaggaaatgcagaccaaattcattcttattatgtggtgaacgggattgctgttcatgcctcaaaagaggttatggaaaaagtggcgcagtttcccgaagtggaaaaggtgcttcctaatgagaaacggcagctttttaagtcatcctccccatttaatatgaaaaaagcacagaaagctattaaagcaactgacggtgtggaatggaatgtagaccaaatcgatgctccaaaagcttgggcacttggatatgatggaactggcacggttgttgcgtccattgataccggggtggaatggaatcatccggcattaaaagagaaatatcgcggatataatccggaaaatcctaatgagcctgaaaatgaaatgaactggtatgatgccgtagcaggcgaggcaagcccttatgatgatttggctcatggaacccatgtgacaggcacgatggtgggctctgaacctgatggaacaaatcaaatcggtgtagcgcctggcgcaaaatggattgctgttaaagcgttctctgaagatggcggcactgatgctgacattttggaagctggtgaatgggttttagcaccaaaggacgcggaaggaaatccccacccggaaatggctcctgatgttgtcaataactcatggggagggggctctggacttgatgaatggtacagagacatggtcaacgcctggcgtgcggccgatattttccctgagttttcagcggggaatacggatctctttattcccggcgggcctggttctatcgcaaatccggcaaactatccagaatcgtttgcaactggagcgactgatatcaataaaaagctcgctgacttttctcttcaagggccatctccatatgatgagataaagccggaaatatctgcaccgggcgttaatattcgttcatccgttcccggtcagacatatgaggatggttgggacggcacatcaatggcagggccgcatgtatccgctgttgctgcactgctgaaacaggcgaatgcctcactttctgttgatgagatggaggatatattaaccagcacggctgaaccgctcacggattcaacatttcctgattcaccgaataacggatatggccatggtctggtgaatgcttttgatgctgtatccgctgttacagatggtttagggaaagcggaaggacaagtttctgtagagggggatgaccaagagcctcctgtctatcagcatgagaaagtaactgaagcttatgaaggtggtagcctgccactgactttgacagctgaagacaatgtgagtgtgacatctgtaaagctgtcctacaagcttgatcaaggtgaatggacagaaataacggctaaacgaatcagcggtgatcatctaaaaggaacgtatcaggcagagatcccagatataaaaggaactaaactaagctataagtggatgattcacgattttggcggtcatgtcgtttcgtctgacgtatacgatgtaacagtgaaaccaagcatcacggcgggatataagcaggactttgaaactgcacccggcggctgggttgcgagcggaacaaataataactgggaatggggagttccgtcaactggcccaaatacagcagcatccggagaaaaagtatatggaacgaatttgacaggaaattatgccaactcagcaaacatgaaccttgttatgcctcctattaaagcacctgattcaggaagtctgttccttcaatttaaaagctggcacaatttagaggatgattttgattacggctacgtttttgttcttccggaaggtgaaaagaattgggagcaggctggtgtctataacggaaagacatcaagctggacggacgaagaaattgatttatcggcttataaaggccaaaacattcaagtgatgtttaaccttcaatctgatgaaagcattgcaaaagagggctggtatattgatgatgtagtgctttctgacaaatcagccggaaaaacagtcaaaaagaataagctgggcgtcgaaaagccgtctggaaagcaaaagaaaaagccagtaaatccgaaaaaggctaagccatctgcaaacacagcggtaaaacatcagaacaaggctatacagcctcaagttttgccgctcagggcacaagtcagtgtagtggaaacaggaaaatcaacatattcagatcaatccacagggcagtacacgctgaagcacaaagcgggagactatacgcttatggcagaagcatatggttatcagtcgaaaacacaaaaagtatctttaaagacggatcagacgacacaagctaattttacgttagaagagatgaagaagggcacattaaaaggcatggtcatcaataaaacgacaggagagccggtaacaggcgcttccgtttatgttgtagaggatgctgctgtggaaccggctatgacaaacgacaaaggtgaatatacgctggaggcctatgaaggcgcttatacgattaaagtcgctgcaccgggttattacagtgatgaattttccgttgagttaaaaggtgatgttacaaaagaaactgcattgaagcctttcgtcggttatccgggtgaaattgcatatgatgacggaacagcggagaatgccaattcctattttgctgccggtaacggatgggcggtaaaaatgacgctcgctgacggcaaggacaaaggcatgcttacaggagggctgttcagattctgggatacagagttcccagatccgggcggcacagagtttaaggttgaggtatacgatgccacaggaaaagacggagcaccgggcaagaaaattgcagggccatttaacgctgaagctcttcgcaatggcgagtggactaaggtagatctcagttcaaaagggattatggtcgatagagacttttatctcgtatatatccagtcaaaacctgacccgtattcacctggactggcaatggatgaaaccggcaagaattccggccgcaactggcagtatataggtggacaatgggagccgggtgacgaagcagacggcaactatatgattcgcgcattagttaattatgaagctgctgtacctgagattacttcaccgacagacaaatcatacacaaataaggatagcgtcactgtaaaaggaaacgcttctcctggcacaacggtacacatttataatggagagaaagaagcaggagaaacgaaagctgctgcggatggcacgttccatgcaggcatcatactcaacaagggtgaaaatgagctgacggcaactgcatcaactgacaacggaacaacagatgcctccagcccaatcacggtcacgcttgatcaagaaaagcctgaattaacactggacaatccaaaggatggcgggaaaacaaataaagaaacgctgactgtcaaaggggctgtatccgatgacaatctgaaagacgtcaaggtgaatggcaaaaaagcaacagtagctgatggttcatactcagcccgtattcttttggaaaatggaagaaatgaaatcaaggtaattgctacagacttggcaggcaacaaaacgacgaaaaagacagtcattgatgtgaactttgacaagcctgtcatttccggcttaattccgggagaggataaaaacttaaaagccggtgaatctgtgaaaatcgctttctcaagcgctgaggatttagatgcaacgtttaccattcgtatgccgctgacgaatgcaagagcgagtgtgcaaaatgccaccgaactcccgttaagagaaatctctccggggagatatgaaggctattggactgccacttcttctattaaagcaaaaggagcaaaagtagaagtgatcgtccgagatgattatggaaatgaaacaagaaaaactgcgaatggaaaacttaatatcaacacagaaaattaagtggaaaaaagctgccgtcattggcagtttttttatatcctctcattatacttcctcgacaaattaagcagatttccctgaaaaattgtattttcctctcaacattaattgacagactttcccacagagcttgctttatacttatgaagcaagaaggggaacagcgtgaggcaagaaagaaaggagtcagatgtgaaaatctatttagatgtcatttggctgttaaacttttgttttgatgcacttttgcttttgctcacggcatttattttaaaacggcatgtaaaaaaaagaagactggtaggcggagcgttcatcggttccagtattgtccttttgatgtttactcctttttcgccgattgttgaacatccggctgggaagctagctttttcagttgtgattgtggtggtgacatttggctttaaaagatttcggtttttctttcaaaatttgttttccttttattttgccacttttttaatggggggaggaattatcggagcccattctttgctgcagtcaaattctattgttcaaaacggtgttatgattaccaatcaaacagggtttggagacccgatcagctggttgtttattgttggtggctttccagcattatggtttttttctaaaagaagaattgaagatattgaaacaaaaaacattcaatatgaggaacgagtcagcgtgcaggcagatttgggcagccaaacacttcatgtcagaggcctgattgattccggtaatcagctgtacgatcctcttacaaaaacaccggtaatgatcatttacattgataaattggagccgattttcggaacagccgaaacgatgatcattcgaaacacagacccattggaagccatcgaacagctcgatgattcctttcgctttttagataaaatgaggttgattccatacaggggagttggtcagcaaaatcaatttttattatgcgttaaaccggatcacgtaacgattatgacaaaagaagaaatgatttctgcagataaatgtttaatcggcatcagcacaacaaagctgtcggcagatggagagtttgacgcgattattcatccgaaaatgctttcgggcaaggctgtcaaacacgtttcataatgttcgcaaatgtccgttacttatcatactcaaacggcgtgacatttagaagggagaggaagatgaaaaaactgaaattacggttgacgcacctctggtataagctgctgatgaaacttgggctgaaaagtgatgaagtctattacataggcgggagtgaagccctgccgcctccattatctaaagatgaggagcaggttttgttaatgaagctcccaaacggcgatcaggcggcgcgcgccattctaattgaacgcaatttgcgtctggtcgtatatatcgcccgtaaatttgaaaatacgggaattaatatagaggatttaatcagcatcggtaccatcggtctaatcaaagctgtgaatacattcaatccagaaaagaaaatcaagcttgctacctatgcctcccggtgtatagaaaatgaaatcctgatgtatttaagaagaaataacaaaatccgttcagaggtttcctttgatgaaccgcttaatattgattgggacggcaatgagcttttgctttctgatgtgctcggcactgacgatgacatcatcactaaagacatagaagctaacgtcgataaaaagcttttgaaaaaggcgcttgaacagcttaatgagagagaaaagcaaatcatggagctgcggtttgggcttgtcggtgaagaagaaaaaacccaaaaggatgtagcggatatgatggggatttctcagtcttatatttcgcggcttgagaaaagaattataaaaagattgagaaaagagttcaacaaaatggtgtaaaaaattttatggttagaaccccttgattttacagggatttcctgatttcgacagtttttcggtctgagtgcagtgcatatttttcccacccaaggagatacttaacgttgtacagcagctcctgtagggagggaaaaaagtgtcgagaaataaagtcgaaatctgcggggtggatacctccaaattaccagtactcaagaatgaagagatgagaaagctgtttaggcagctgcaggatgaaggcgatgattcagcaagagaaaagcttgtaaacgggaacttgcgtcttgtcttaagtgtcattcaacgatttaataacagaggggagtatgttgatgacttatttcaagtcggctgcatcggactaatgaaatccattgataattttgacctaagccacaatgttaagttttcaacatacgctgtacctatgattatcggagagatccgcaggtatttacgcgataataacccgatccgtgtctcaagatcactccgggacatcgcttacaaggcgcttcaggtaagagagcggttaatcagtgagacaagcaaggagccgactgcagaagacatcgcaaaagttcttgaagtaccgcatgaggaaattgtatttgcgcttgatgccatccaggatccggtttctctatttgaaccgatctataacgacggcggagacccgatctatgtgatggaccaaatcagtgatgagcgtaatacagattcacaatggattgaagagctggctttaaaagagggcatgagaaggctgaacgatagggaaaaaatgattttgagaaagcgattcttccaagggaaaacccaaatggaagtcgccgaggaaatcggaatttctcaagcgcaggtgtccagacttgaaaaagcggctatcaaacaaatgaataaaaatattcatcaataatgaaaagcctttaaaacgatgttgttttaaaggcttttctattgattatggatggtttacgttttggaaaaagtaaggtatcctagttcgtacaaagttttatgaaaattaaaacaattataaaaggcaataaagaggaggaccacgatgattttgcagcttgacaatgtctcactaaaacggaatgggaaatggatactgagagatattgattggaaggtggaagaaaaggaaaattgggtgctttacggcctaaatggcgccgggaagacagcgctgttaaatatgctttgctcatattattttccaacatcaggcgagatgcaggtgcttggccatgaatttggcaaaacagagcttggggaaaagctcagacgtaaaattggcctcgtctcagctgctcttcagcaaaaattgtacccggcagattcagcctttgaaattactttgagcggagcttacgcttcgattggtttatatgaaacgccaagtaaggaaaccagggaaaaagcgattggtttgttagaggacttgggagcaattgaatatgccgatcgccgctatgaaaccctttctcaaggggaaaaacaaagagcgttgattgctagagcactaatggccgatccggagttgctgatactggatgaaccagtcacagggctggattttattgcccgggaaaagctgttagatacgattacatacattgcaaacaaagaaaatgcaccatctatcctttatgtgactcatcatgctgaagaaattttgcctgtctttgataaagcccttttattaaaacagggagaggtctttggatccggagaaataaaggaaatgcttactgatcaaatactttccgctttttttgataccccaatccatgtattatggaatcaggatcggccgtttttaacaagagctgagccgataacgaatgcctgacaaacatatatagattcatcctaggggtgctttgcgaagctgagagagactttgtctcaacccttttgacctgatctggatcatgccagcggagggaagcggtgaaaagcggagtacatcggactccgtttgtttttattaagccgtttcatcacatttgaaacggcttttttgattttaaagaataggagcggatttacattggatcaacaaatagactctttgcaaaaaaaagtggaagaacataaggaggagcttattcagcttgcgaaaacgctgatttcttatcaaacacctgctccgcctgcaagaaatacagagggcattcagtcatggattgcgggatatttaaatgaattgggattctcgatcgacaaatgggatgtgtaccctggagatcccaatgttgtagggaagctaaaaggaacagattcagcagattattatagcctgattatcaatggccatgtagatgtggcagaggtaaaagaggatgaagaatgggagcatgatccatttcatccaattgaaaaaaacggtctcttaatcggtcgaggcgcttccgatatgaagggcggaatggcgtgtgtgttgtttgctgtcaaattaattcgtgaagccggcattgagcttccaggtgatctgattctgcaatcggttattggggaggaagttggagaggccggcacacttgaatgctgcaagaggggctaccacgctgattttgcaattgtcgcggatacgagcgatatgcatattcaaggccaaggcggtgtcattacaggctggatcgaaatcaaaagcagtcaaacatttcatgatggaacgagacggaatatgattcacgcaggcggaggaacattcggagcaagcgcaattgaaaaaatggcgaaaatcattgcggggctcggtgaacttgagcgccactggtccattatgaaaagttatcccggttttaaaccaggcacaaatacgattaatccggcagttatagaaggcggcagacatgcggcttttatagcggacgaatgccggctgtggatcacagtccatttttatccaaatgaaacccatgaccaagtggcagcggaaatagaagattacgtcaatcggctgagtgacagtgatatttggcttagggaaaaccgccctgtattcaagtggggaggctcatctatgatagaagacagaggagaaatttttccggcattggaagttgactctggccacccaggcgtcttagcgctaactgcctctcatcagaaagtgaaacgggagtgtccaattattgacgtttctcaatcagttacagatggcggatggctgtatgatgccggtattccatgcgtaatatacggtcctggagatctgcacaatgcacactctgtgaacgagaaggtatcgattgagcagctagtagagtatacaaaaattatactcgattttatcatcagctggtgcagccggaaaaaagaacaatgacatgaaaatttcttcttgctgacaaggttcagcctgcccgttcatatacttgaacaaaaggacggaaaaaggacgtgatggaatgatcagcatttcagaatttcaggtaaaggatgtcgtcaatgtctcaaacggaaaaaagctggggagtattggtgatattgatatcaatgtgaccactggaaaaattcaggcgatcatactcggaggaaatgggaaagttctcggattttttggaaaagaagaggaattggtcattccatggcgaaatatagtaaaaatcggggaagatgtaatcttagtccgattaagtgaaccacatgcataaacctgcttgtctgccgcagattggcaaatgccggaagtctcgattcttccggcacatttcatttagaaatatgcaaatcggcgctcaacgaatgcagtaagatgtggtaaaataagtgggaaattccgcttttttaaatgtttgtcgaaaggttggatcatcatgaatacatatcacccattcagtcttaccacaccctcgacactcatgatacaagactgggttcaaacgaatcaaaacaacaaaaaagtcattgccggatttacgacaaaaaacggcggtgtcagccaaaagccttttgaatcgttaaatacaggattgcacgttcatgacaaagatgcagatgtagttaaaaatcgtgaatatattgccgatatgtttaatactgatttgcagtcttgggtattcgctgatcagacacatgataatcgcgttcagaaagtgacgcagagggataggggaaaaggcgcccgtgagtatcacacggctctaaaagcaacggacgggctatatacaaatgaaaaaaatgtatttttagcattatgctttgctgattgtgtgcctcttttcttttatgatccggttaagtcgcttgtcggagtcgcccatgccgggtggaaaggcaccgtcaaacagattggcagagaaatggtgaagcaatggactgagaaggaaggttcaaatccctcagatatttacgctgttattggcccgtctatcagcggagcatgctatacggtagacgaccgcgtcatggatgctgtccgcgcattgccggtttcagcagaccttgccgttaatcagacggcaaaggcacaatatcagcttgatctgaaagagctgaaccgtcttatactgatggacagcggtttggcaagtgaacaaatttctgtcagcggtttatgcacggaaagcgagccgtctcttttctattctcaccgccgcgatcaggggaaaactggacggatgatgtcctttatcggaatgaaggaggcataaaagatcttgcgtgttgttgataatttacgacatataaacgaacgaataaacgaagcatgtaacagatcgggccgcagctccgacgaagttacggttattgcagtcacaaaatatgtatcacctgaaagagcacaggaggcagtagatgctggcatcacctgcctcggagagaatcgggatgcggaactgctccgcaaacaggaattgatgaaagggaatccggaatggcattttatcggcagtctgcaatcaagaaaagcaaaatctgtcgtcaatgcggtttcctatatccattccctagaccggctctcattagcgaaagaaattgaaaaacgggctgaaggtactgtacgatgctttgtgcaggtcaatacctctcttgagccttctaaacatggcatgaaaaaagaagaagtcattccattcatacaggagctttccggtttcgaacatatccttgttgccggactgatgacaatggctccgctgactgatgatcaagatcagatcagaagctgtttcaggtcgctgagagaactccgtgaccaggttcagaagctgaaccagccgaacgctccgtgtactgaactgtcgatgggcatgtcaaatgattttgaaattgcaattgaagaaggagctacttatattagaatcggctcatcgttagtcggaaatgaaacagggggtgtacagcaatgagtatgaaaaataaactgaaaaactttttctcaatggaagatgaagaatacgaatatgaatatattgagacagagcgggaatctcatgaggagcatgagcaaaaagaaaagccggcttatacggggaataaaccttcgggcaaacagaatgtagtgagcttgcaaagtgttcagaaatcctctaaagtggtgttgagtgagccgcgcgtttatgcggaggcgcaggaaatagccgaccatttgaagaaccggcgggcagttgtcgtcaatcttcagcggatacagcatgaccaggcgaagcggattgttgactttttaagcggaaccgtttatgccattggcggcgatattcaaagaatcggctcagatattttcctctgcacgcctgacaacgtagatgtatcaggcacaatttctgagctcatatctgaagacgaacatcagaggtggtaaagcgagatgatcctttatcaagttttttcggttttaagcttattaatcacaatatactcatttgccctgatcatatatatttttatgtcatgggtgccgagtacgagggaaacagcagtcggacgttttttagcttcgatttgtgaaccatatctcgaaccattcagaaaaatcatccctccgattgcaatgctggatatttcaccaatcgtagcaatacttgtgcttcggtttgcgacaaccggcttgtggggactttatcgcatgattgcgttttaatgtgacagtttgataggggcttggcagcagccaagcctctttacatagaagggaaagacgatgagcgatatatatcagcacttcagaaaagacgagcgggcctttattgatcaggcgctcgaatggaaaagaattgtccaggagcagtaccggatgaagctgaccgactttttagatccccgagagcaggtcatcctctctgctgttacgggacaggctgatgtcgggcttgctttttccggcggctatgacagagcggagcgaaaacgggcgattctgtatccagagtacattactccggaagaatcggattttgaattgcaggcgtttaacgtccgttatgctgacaagtttgtctcagtagatcatcgttctctgcttggtgcattaatgggcataggattaaagcggcaaaaattcggtgacatcgtgttttctgagacagcagtgcaattgattgtctcagccgataccgctgattttgtggctgcacagctgacccaagcaggcaaagcggcggtcagcctagagaaaattgacttgtcagaccttaacattccagcagttgatgtcgaaataagagatgacacggtttcttctttaaggcttgacgccgtctgcgcctctatgagcaggcaatcccgccagaaatcacagacgcttgtgaaaaacggccttgtgaaagtgaactggaaggtggttgaagatccttcatacatagtcgcggaaggggacatgctgtcaatcagaggttttggccggtgcagcttaacaaaaatcgaaggaaaaaccaaaaaagacaaatggagagttacgtttgaacgacaaaaatagtcggtttttcagtttttttctccatctgtgcgaaatttgttttataatgtgaactagataaccgtactgaaatgtaaaaaatggaggtggcatcatgccattaacgccaaatgatattcacaacaagacgtttacaaaaagttttcgcggatatgatgaagatgaagtaaatgaattcctagcccaagtcagaaaagattacgaaattgttctccgcaagaaaactgagcttgaagcgaaagtcaatgagctagatgaaagaatcggacactttgccaatattgaggaaacattgaataaatcaattttagttgctcaagaagcggctgaagacgtaaaacgcaattctcaaaaagaggcaaagctgattgttcgggaagcggagaaaaacgctgatcgcattatcaacgaatcgttatcaaaatcaagaaaaattgcaatggaaattgaagagctgaaaaaacagtctaaagtgttcagaacacgtttccaaatgctgattgaagctcagcttgatcttctgaaaaatgacgattgggatcatctccttgagtatgaagtcgacgctgtatttgaggaaaaggaataaattctctgattatcttgacattttcttagcttgtcgaatataatacgttcataaattcagatgaaaaaacggttgaaagggacagtcatgtttccttcaggccttcatagcgacccggagatggtgagagtccgggatggccggaatcatgtagatcagccctttagtttccttgctgaactcacagtaggttaggacgttcatcacgttacgatgctcaagaggaaaaagtgtatgctggctttttctaaaagggtggtaccgcgagataagctttctcgtcccttatgggatgagagggctttttttattttctgaaaaaatgcagtggaggaatgaaaatggattttaaagacacgctcttaatgccgaaaacagatttcccgatgcgtggaaatttgccaaaccgtgagcctgacattcaaaaaaaatgggaggaagaggatatctaccgtcttgttcaggaacggacgaaagaccgcccgaaatttgttttacatgacggacctccgtatgcaaacggcgacatccatatgggccatgcacttaacaagattttgaaagacttcattgtccgctataaatcaatgagcggctacaacgcaccgtatgtgccgggctgggatacacacggattgccaattgaaacagctctgacaaaaaacaaaaaggtcaaccgcaaagaaatgtcagtagcggaattccgcaaactatgcgaagagtacgcttggaagcaaatcgagggacagcgtgagcaattcaaacgtcttggtgtccgcggtgactgggaaaacccatacgtgacattaaaaccggaatacgaagcgcagcaaatccgcgtatttggtgaaatggcaaaacgaggctacatttacaaaggccttaaaccggttaactggtcaccttcaagtgagtctgctctggctgaagccgagatcgaatatcaagacaaacgttcagcatctatttacgtcgcttttggtgtaaaagacggaaaaggcgttcttgaaaacggcgagcgcatcattatttggacaacaacgccttggacaattccggcgaacctcggaatttcagtgcaccctgatcttgagtacagcgtgattgcagtaggtggtgaccgctttgtcgtagcaagtgcattagtcgaaaatgttgcatcggcatgcggatttgatcagtatgaagtgacaagaacggtcaaagggaaagaccttgagaacattatcgctgaacacccgctatatggcagagactctctcgttatgcttggtgaacacgtaacaactgatgccggaacaggctgtgttcatacagcgccaggacatggggaagatgactttatcatcggccaaaaatacggtttagatgtgctttgcccggttgatgaaaaaggtgtaatgacaagcgaagctcctggctttgaaggcatgttctatgatgatgcaaacaaagcgatcacacagcagctcgatgaaaaaggcgcacttgtgaagcttgaattcattactcactcttatccgcatgattggagaacaaaaaaaccaaccattttcagagcgacagcgcaatggtttgcgtctattaaagatttcagatcagacctgctggatgccattaaagaaaccaaatgggttcctgaatggggcgagcagcgtttgcacaacatggttcgggaccgcggagactggtgtatttcgagacagcgtgcgtggggtgtgccgattccggtattttacgctgaaaacggagaaccgattattacagatgaaaccattgaacatgtttctgaattgttcagacagcacggatcaaacatttggtttgaaaaagaagcaaaggatcttcttccggaaggctttacgcatcctggcagcccgaacggcacatttacaaaagaacaggatatcatggatgtttggtttgattcaggctcttcacatcaagcagtgcttgaagaacgtgatgacctcgttcgcccggctgatttatacctagagggatctgaccaatatcgcggctggtttaactcttctctttctacagcagtagccgtaacagggaaagcgccgtataaaggtgtgctaagccatgggttcgcactggatggagaaggacgcaagatgagtaaatcaatcggtaacgttgttgttccggctaaagtcatgaaacagcttggtgccgacatcttaagattatgggtatcttcagtggattatcaggcggacgttcgcgtgtctgacgccattctaaagcaggttgcggaagtatatcgtaaaatccgcaacacgttccgtttccttcacggcaaccttttcgattttgatccaaaaacaaatgcggtggctgtcgaagatcttcgtgaagtggatcagtatatgctgattaagctgaacaagctgattgataaagtgaaaaaagcgtatgatgagtacgaatttgcggttgtgtatcacagcattcataatttctgcacaatcgaattgagctcattctaccttgattttgcaaaagatattgtctacatcgagcatgcggatcatccggatagacgcagcatgcagacagtattctatgaaacgcttcttgctttagtgaagctttcagcgcctatccttccacatacggcagacgaattgtggtctcatttaacatttgttgaagagcagagcgttcagctgacagatatgccggaaacaatcgcggttccaaacagtgaagtgactgaagaaaaatttgaccgttttatggctcttcgtgatgacgtgctaaaagcattagaaactgcgcgaaatgaaaaaattatcggtaaatctttggaagcaaacctgaaattgtatccaaacaaagaaaacaaagagctcttggcttccataaaagaaaacctttctcagctgtttattgtgtctgaactgacaatcagcgaagaaaatgatgcgccgaacgatgcgcaaagctttgcgacgggtaaaatcgctgtcgagaaagcggaaggcgaaatgtgtgagagatctcgtgtgatttcaaaagatgtaggggcaaatccgaaatatcctacactttcattacgcaacgctgaaatcgttgaaaaatactatcaaaaataatgaaaagggcccggcgtaaaagccgggctttttttgtgccaagagtgacatcctttagaacggcaggaaaaatcttatgggctttagatcatcattcataggcaacaataaaggtactacgttaagagcaggagttgtgaagaatgaatgatcaactgaccgcaatttatacggaacttcttctgatgaaagaagaattacagtcgagattatttgagtattcttgctttcaggtttctacaagcccgcaagcagcaatcaatcataaacaaaaagcaactctgatctatcatattaaagaagagcttcaagacgttctccttgcattgtccaaaatcgaaaacggcacattcggatactgtgaagaaaccggggctcccattcctctttcaaagctggcagtgctgccgacggcccgaacagcaaacgattttctttattctgtccaatttgagaaaaaaacgcttccgatatggaaatcaacggatatcgaatatggtcaggcactgtatgaataacagtgtctggccggttattatgcctgatatttctttactccagtgctttttattgataaaatgcataatggattaaagtaaccgtaaactggaggaacgtttgtgctgtattatatgattgcactacttattattgcagccgatcaattgacaaaatggctagttgttaagaacatggaacttggccaaagcattccgatcattgatcaggtattctatatcacctcccatcgcaatacgggtgctgcatgggggatattagcgggtcagatgtggtttttctacctcataacaaccgctgttattattggtattgtttattacatacagcgttatacaaaaggacaaaggcttcttggcgttgctctcggacttatgcttggcggtgccatcggcaactttatcgatcgggctgtcagacaggaagttgtggattttatccatgttattattgtcaattacaattacccgatatttaacatcgcggactcttcattatgtgtcggcgtaatgcttttatttatacaaatgctgttggacagcgggaaaaagaaaaaggagcaatagcatgaatcaaattgatataaccgcttcagaagaacaaaaaagtgagcggattgataaatttttggcatcgactgagaatgattggtcaagaacccaggttcagcaatgggtaaaagacggacaggttgtcgtgaacggaagcgcggtgaaagcgaattataaaattcagccgggtgatcaggtgaccgtcactgtacccgaaccggaagcgctcgacgtcctggcagagcctatggatctggatatttattatgaggaccaggatgtgctggtcgtcaacaaacctcgcggaatggttgttcacccagcacccgggcatcttacgggcacacttgtaaacggccttatggctcattgcatagacctttccggaataaatggtgtgatgcgcccgggtattgttcacagaatcgataaggacacgtccggtttattaatggtggcgaaaaatgatatggcgcacgagtcacttgtaaaccaattggtcaacaaaacggtcacgcggaaatatacggcagttgtccacgggcttatttctcacgatgatggcacaattgacgcgccgatcggacgagataagaaagaccgtcaaagcatgactgtgacacgtgatggcaaaaacgctgtcactcattttcatgtactagagcgttttcaggattttacgttagtggaatgccagcttgaaacagggagaacccatcaaattcgtgttcatatgaaatatatcggcttcccattagcaggcgatccgaaatacggcccaagaaaaacaatcgactttaatggccaagcgcttcacgcgggagttttaggttttgaccatccacgaacaggagaatatgtcgaatttgaagcgccgcttcctgaggatatggcagaattaatcgaaaacctcagaaaaaacggttgacagagggtttcttttctgaaataataaacgaagctgaatagattctttaaaacagtccagagaggctgagaaggataacggatagacgggatgcgtgtataggcgcgcaccttgtcctaaaacccctctatgctctggcaggaggggttttttcttctatatgaactgtgaggtgtcacacattgaatcaaaaagctgtcattctcgacgaacaggcaatcagacgggcgctgaccaggattgctcacgaaatgatcgaacgcaataaaggaatgaataactgcattcttgtcggcattaagacaagagggatttatctggcaaaacgccttgcggaacgcattgaacagattgagggaaatcctgttacagtcggtgaaattgatattactctttacagagacgatctttctaaaaaaacgagcaacgatgaaccgcttgtaaaaggtgcagatattccggtagatatcacagatcaaaaagtcattctcgttgatgatgttctgtataccggaagaacagtcagagcaggaatggatgcgcttgttgatgtaggcagaccttcctccattcagcttgcagtgcttgtggacagaggacaccgggagctgccgatccgagcggattatatcgggaaaaacatcccgacatcaaagtctgaaaaggttatggttcagcttgatgaggtagaccaaaacgatctcgtcgccatttatgaaaacgaataatagatcacctttttaagggcaatccagagaggttgcaaagaggtgcacaacaaaggcccaaaaagcattcggcaggtctttgtatgcctctttgcgtaaaaaagcaaagaggtttttttatacagtcattgagtcatcctaaaatgaaagtcaacaatcagggggaaatcatcatgagtaagaaaaaagtaaatttaggggtcagggatgtcccgacacctttctcttgggtttcattcagccttcagcatttgtttgccatgtttggctcaaccatcttggttccgaagctcgtcggaatgagtcctgctgtggcgttggtgacaagcggcatcggaacactggcgtaccttcttattacgaaagggcaaattccggcgtatctcggttcatccttcgcctttatttctccgatcattctggtaaaagcgaccggcgggccgggagcggcaatggttggagcgtttcttgcagggctggtgtacgggctgattgccttattgatcaggcagcttggaacaggatggctgatgaagattctcccgcctgtagtcgtagggcctgttattatcgtcatcgggctgggactggcaagcactgcggtaaacatggcgatgtatgctgatccaaatgcgagtgagttggtctacagcttaaagcactttagtgtcgcaggagttacgctggcaatcacgattatttgtgcgattttcttacgaggatttttaagcctgattccggttctgatcggaatcatcggcggatacctgtttgcccttactcaagggattgtcaacttccagccggtgcttgacgcgaaatggttcgcagtgcctgaatttatcattccgttcaaagattattcaccatcagttacactcggcatcgcagccgcaatggttcctgtcgcatttgtcacaatgtcagagcatatcggccaccaaatggtgctgagcaaggttgtcggacaagacttcattaaaaagccaggtcttcatcgctctattatgggtgacagtgtggcgacaatcctcgcttccctgatcggcggtccgccgacaacgacttacggagaaaacattggcgtgctggccatcacaagagtattcagcgtctttgtcatcggaggagcggcagtgattgcctgttgcttcggctttatcggcaaaatttcagcgctgatcagttcagtgccgtcagcggtcatgggaggcgtctccttcctgctgtttggaatcattgcttcaagcggtctgagaatgctgattgacaacaaaattgattatgaaaacaacagaaacctcattattacatcagttatccttgtcatcggtgtaggaggcgcttttatccaagtgtctcaaggcggattccaagtgtcaggaatggcgcttgccgcaattgtcggtgtcatcttaaacctgattcttccgcaggcgaaggaagagcagaaagacacatctgaacaacatcatatctaaaaccttttaatgaaagtccagagaggcttggaagggttatgaagagaagggagcttcaatgctgccctctatttaaccataccccgagtctatcttagaccggggtttttttcagccttaagttgaaaagagaggggaaagaacatgaagcatttaacgacgatgagtgaactcggcactgaggaaatcaaagatttgcttcaaacagcacaagaccttaaaagcggaaaaacagacaatcagcttacaggaaagtttgccgcaaacctgtttttcgaaccgagcacgagaacgcggttcagctttgaggtcgcagaaaaaaagctgggcatgaatgtgctcaaccttgatggaacaagcacaagcgtgcaaaaaggcgaaaccttatatgacacgatccggacgctcgaatcaatcggtgtggacgtctgcgtcatcaggcacagtgaggatgagtattatgaagagcttgtcagccaggtgaacattccgattctgaatgcgggagacggatgcggccagcatccgacacaatcactgcttgatttaatgacgatttatgaagagttcaatacgttcaaagggcttaccgtctccattcacggcgacatcaagcatagcagagtggcaaggtcaaatgcggaagtgttgacaagattgggtgcccgggtcctattttccggcccttcggaatggcaggatgaagaaaatacattcggtacgtatgtctcaatggatgaagcagttgagtcttccgatgttgtcatgctgctgcgcattcaaaatgaacgacatcagtccgctgtcagccaggaaggctatttaaacaaatacggcttgaccgtagaacgggctgagcgtatgaagcggcatgcgatcatcatgcatcctgctccggtaaacagaggagtggagattgatgacagcttagtagaaagcgaaaaatcaagaatcttcaagcaaatgcaaaatggcgtatttatcagaatggcagtgatacagcgtgccttacaaaccaatgtgaaaagaggagaagcagcgtatgtcatatctcattaaaaacggctggatactaaacgaaaatggtgaaaaaacagaagcggatatccgagtgactggagaaaccatcaccgcaatcggcaagcttgatgcaacggataatgaaacggtaattgatgcgaaaggtttgctcgtttcacctgggtttgttgatctccacgtgcatttcagagagccgggcggagagaaaaaagaaactattgaaaccggggccaaagcggcggcacgcggcggctatactacagtagcagcaatgccgaatacgcggccggttcctgatacaaaggagcagatggaatgggtgcaaaacagaattaaagaaacatcatgcgtcagagttcttccatatgcatccattacgatcaggcaaatcggcgatgaaatgacaaactttgaagcattaaaagaagccggggcatttgcttttacagatgacggtgttggtatacagacagcaggtatgatgtatgaagcgatgaaacgggcagctgcaattgacaaagcgattgttgcacattgcgaggacaactccttaatttacggaggaagcgtacatgaggggtcattctccaaagcgaacgggctaaacggcattccttctgtgtgtgaatcggttcatattgcccgcgatgtgctgctggctgaggcggcaaactgccattatcatgtatgccatatcagcacgaaagaatctgtcagagttgtacgcgatgcgaaaaaagcgggaatcagagtgacagcagaagtgtcgccgcatcatttgctgctttgtgatgaggatatcccggggctggacacaaactataaaatgaatccgccgctccgcagtgcagaagacagagctgctttaattgaaggtcttttagacggaacaattgattttatcgcaacagaccatgcaccgcatacggaagaagaaaaaaacacagaaatgaaactggcgccattcggaattgtcggcttagaaacagcattcccgcttctttacacacactttgtcaaaaatggcagctggtcgctgaagcagttgattgactacatgacaatcaagccatgcgaagcgttcggtctcccatatggaacattacaaacggggcaagctgcggacattacgttaatcgatttagaaaaagaagcagttatagacaaagacacgtttttatcaaaaggaaaaaatacaccattcaacggcatcagctgcaccggctggccggtcgctacaattgcggcagggaagcttgcttatgaagaggggagacttgtcaaatgaagagacgattagtactggaaaacggagcggtattcgagggagaagccttcggaagcttagaacacaacatgggagaagtcgtttttaatactgggatgacaggctatcaggaaattttatctgacccttcttactgcggacagatcgtaacattaacatacccgcttatcggaaattacggcattaaccgtgatgattttgaatccattaccccttttgtaaaagggctgatcatcaaagaattatgtgagctgccttccaactggcgttcagcatacaccttagacgagtatttaaaaatgaaaaacattcccggactccaggggattgatacaaggaagctgacaagaatgatccgcacggcaggcgcgctaaaaggaacattcgcttcatctgatgaagatatcgaagcagtgctgaaaagactgaacgaaacggaattgccaagaaatcaagtatcccaagtatcagcaaaaacagcatatccgagcccgggaagaggcaaacgcatcgtcttggttgacttcggcatgaaacacgggattctaagagagctgaacaaacggaaatgtgacgtcatcgttgtgccttacaacattacagcggaagaggtgcttcagctgaaaccggacggtatcatgctttctaacggacctggagacccgaaggatgtgcctgaagcgattgaaatgattaaaggtgttcttggaaaagtgccattattcggaatatgtcttggccaccaattattcgcgctggcgtgcggggcgaatactgaaaaaatgaaattcggccacaggggctcaaaccacccggtaaaagagctggctacaggaaaagttgccttaacatctcaaaaccatggatatacagtttcgtctatcagtaaaacagaactggaagtgacgcatatcgcaattaacgacgatacgattgaagggctgaagcataaaacattgccggcatttacggttcaatatcatcccgaagcctcacctggtcctgaggatgccaaccatctatttgacagattcatcgaaatgatcgaaacaacagagaaagaaggggaagcggtatgccaaaacgcgtagacattaacaaaattttagtaatcggatctggaccgatcatcatcggccaagcagcagaatttgactatgcgggaacacaagcctgtcttgctttgaaagaagaaggctatgaagtcatccttgtcaactcaaaccctgcaacgatcatgacagatacagaaatggctgaccgggtttacatcgaaccgctcacacctgaattcctgacacgaatcatcagaaaagagcgcccggatgccattcttcctacactcggaggccaaaccggtttgaatcttgcggttgagctttctgaaagaggcgttttggcagaatgcggcgtcgaagtgcttggcacgaaactgtctgcgattcagcaagctgaagaccgtgacttgttcagaacattaatgaatgaactgaatgaaccggtgcctgaaagtgagattatccactcccttgaagaagcagaaaaattcgtcagtcaaattggattccctgtcattgtccgcccggcatatacattaggcggaacaggcggaggtatctgctcgaatgaaacagagctaaaagaaatcgttgagaacggcttgaaattaagcccggtacaccaatgtcttcttgaaaaaagcatcgccggctataaagaaatcgagtatgaagtcatgagagacagccaggatcacgccattgtcgtttgtaacatggaaaacattgatccagttggaatccatactggagacagtattgttgtcgcgccgagccaaacgctcagcgatcgcgagtatcagctcttgcggaatgtatcgttaaaactgattcgcgcgcttgggatcgaaggcggatgtaacgtccagctcgccttagatccagacagcttccaatattacattattgaagtaaatccgcgtgtcagccgttcatctgctcttgcatcaaaagcaacgggatacccgatagcaaagctcgctgctaaaattgcagtcggactttcattagatgaaatgatgaacccggtgacaggaaaaacatatgcagcatttgaacctgctcttgactatgtcgtatccaaaattccgcgctggccgtttgataaatttgaatcagcaaacagaaagcttggcacgcaaatgaaagcgacaggtgaggtcatggcaatcggccgcacgcttgaagagtcattgctgaaggcagtgcgttcgctggaagcggatgtgtatcatcttgaattgaaggacgccgctgacatttcagatgagcttcttgaaaagcgaattaaaaaggccggtgatgaacgcttattctacttagctgaagcgtacagaagaggctacacggtagaagacctccatgaattttccgctatcgatgtcttcttcttgcataagctgttcggaatcgtacagtttgaaaaagaattgaaggccaatgcgggcaatacggatgtgctgagacgggcaaaagaactcggcttctctgatcagtacattagccgcgagtggaaaatgaaagaatctgagctttacagcttgagaaaacaagcggggattgcgccggtattcaaaatggtagatacgtgcgcggcggaattcgagtcagaaacgccatacttctatagcacatacgaagaagaaaatgaatctgtcgttacagataagaaaagtgtgatggtgcttggttcgggtccgattcgaatcggtcagggtgtcgagttcgactatgcgacggttcactctgtatgggcaattaaacaagcaggctatgaagccattattgtcaacaacaacccggaaaccgtttcaacagacttcagcatctcagacaagctgtattttgaaccgcttacgattgaagatgttatgcacatcattgaccttgaacagccaatgggcgttgtcgtacagttcggcggacaaactgcgattaaccttgctgacgagctttctgcacgcggagtgaaaatccttggaacttcattagaagatttagaccgtgcagaagaccgggataaatttgaacaagcgcttggagaacttggtgttcctcagccgcttggcaaaacagcgacatcagttgatcaggcggtaagcatcgcgagtgatatcggttatccggtactggtgcgcccttcctatgtacttggcggccgggcgatggagattgtttaccatgaagaggaactgcttcattacatgaaaaatgcagtcaaaatcaatccgcagcaccctgtattaattgatagatacttgaccggaaaagaaattgaagtcgatgcagtatccgacggtgaaacagtcgtcattccgggaattatggagcacattgaacgtgcgggcgttcactccggagactcgatcgctgtttatccgcctcagtctctcacagaggacattaagaaaaaaattgaacaatacacgatcgcattggctaaagggctgaatattgtcggtttgctcaatattcaattcgtcttgtcgcaaggcgaggtgtacgtgctagaagtgaatccgagatcaagcagaaccgtaccgtttttaagcaaaattacgggtatcccaatggcgaatctcgcaacaaaaatcattcttggtcaaaagctggctgcgtttggctatacagagggccttcagcctgaacagcaaggtgtatttgtaaaagcgccggtcttctcctttgccaagctgagaagagtggacattacgttagggcctgaaatgaaatcaacaggtgaagtcatggggaaagattcgacacttgaaaaggcgctctacaaagccttgattgcttcaggtattcaaatcccgaactacggttccgtgcttttaaccgtagctgataaggacaaagaagaagggcttgccattgctaagcggttccacgcgatcggctacaacattttagcgacggaaggaacggcaggctacctgaaagaagcttccattccagcgaaggtcgtcggaaaaatcggtcaggatggcccgaacttgcttgacgtcatcagaaacggagaagcgcagtttgtcatcaatacgctgacaaaaggaaagcagccggcaagagacggttttagaatcagacgtgaatcagtagaaaatggtgttgcctgcctaacatctttagatacggcagaggcgatattgcgagtgctggaaagcatgacattccgtgctgatcaaatgccggcagtcaacacaaatcaggaggcggcagtcactatatgaaaaaagcgtatttgacagtatgttctaaccagcaaattgcagaccgggtgtttcaaatggttctgaaaggggagcttgtccaagggtttacaacccctggacagttccttcatcttaaagtgagcgaagcggttacgcctcttttgagaaggccgatcagcatcgcagacgtcaactttgaaaaaaatgaagtcaccatcatttatcgggtagatggtgaagggacaagactcttgtcactgaagcagcagggagaacttgtggatgtcctcgggcctttgggaaatggctttcctgttaatgaagttcaacccggaaagacggctttgctggtaggaggcggagtaggtgtgccgcctctccaagagctgtcgaaacgcttgattgaaaaaggggtaaatgtcatccacgttttaggattccaatcggcaaaggatgtattttacgaggaagaatgcaggcagtacggagacacgtatgtggcaacagctgacggaagctacggggaaaccggatttgtcacagatgtgattaaacggaaaaatctagagtttgatatcctcctcagctgcgggccgacaccgatgctcaaggcgttaaaacaggaatatgcccataaagaagtatatctgtccatggaggaacgaatgggctgcggaatcggcgcatgcttcgcgtgtgtgtgccatacaaacgaaagtgagacatcctatgtaaaagtatgtctcgacgggcctgtatttaaagctcaggaggtggcgctgtaatgctagaggtgaaattgccgggacttgatttgaaaaacccaatcattcctgcatcaggttgcttcggttttggaaaagaattttcacgtttttatgatttgtcttgtcttggagccatcatgattaaggctacgacaaaggagccgcgctttgggaatccgacgccgcgggtagctgagactggtgctggaatgctcaatgcgatcggtctccaaaatccggggctggatagtgtgttgcatcatgagctgccgtggcttgagcagtttgatacaccgatcattgccaatgtcgcaggttctcaagtcgatgattatgttgaagtcgcagaacatatcagcaaagcgcctaatgtccatgcacttgaattgaatatttcctgcccgaatgtgaaaacaggcggaatcgcttttggcacgaatcctgaaatggctgccgatttgacaaaagcggtgaaagaggtttcggatgtacccgtttatgtgaagctttccccgaacgtggctaatatcacagaaattgccttagcgatcgaggaagcgggagcggacggtcttacgatgatcaacacactaatcggcatgagactcgatttaaaaaccggcaaaccgatattagcgaataaaacagggggactttcaggccctgctgtgaagccggttgccattcgcatggtgtatgaagtcagccaggcggtcaacatcccgattatcggaatgggaggcgtgcaaacggctgaagatgccctggaatttcttctcgcgggagcaagcgcagtcgctgtcggaacagcaaactttgtgaatccttttgcatgtccagagattattgaacagctcccatctgttttgctccaatacggctatcaatcaattgaagaatgcatcggaaggagctggaatcatgaaaaacaacctgcccatcatcgcgcttgattttgcgtcagctgaagaaacacttgcgttcttagcgccttttcagcaagaaccgttatttgtaaaggttgggatggagctcttttatcaagaagggccatctatcgtgaaacaactaaaagaaagaaactgcgagctatttttagatctaaagcttcatgacatcccgactactgtaaacaaagcgatgaagcgccttgccagtcttggagtagacctcgtcaatgttcatgctgccgggggcaaaaaaatgatgcaggcagctctcgaaggcttagaagaaggtacgccggctgggaaaaaacgtccgtcacttatcgcggtaacccagctgacaagcacatctgaacaaatcatgaaagatgaactgctgatcgaaaagtctctgattgatacggttgtgcactacagcaaacaggcggaagaaagcggactggatggagtggtctgctctgttcatgaagcaaaagccatttaccaagcggtgtcgcctttatttctgactgtcactccggggatcagaatgtcagaggacgctgcgaatgaccaagtccgcgtagcgacgcctgccattgcaagagagaaaggttcatcagcgattgtagtaggacgctcgattacaaaagcggaagacccggtaaaagcctataaggctgtcagacttgaatgggagggaatcaaatcttgaaacaaatcatcgcaaaacatctattagacatccaagctgtatttttacgcccgaacgagccgttcacatgggcaagcggcattttatcaccgatctactgtgacaaccgccttacgctatctttcccagaggtcagaaacgatgttgcttcaggtatcagcaagcttgtcaaagatcattttcctgaagctgaaatgattgcgggaacagcaactgccggtattcctcatgctgctcttgcggctgaccgtttgaatcttccgatgtgttatgtgaggagcaagccgaaggcgcacggaaaaggcaatcagattgagggagctgtgcaagaggggcaaaaaacagttgtcattgaagacttaatttccacaggaggcagcgtgcttgaagcttgtgcagctttacaagcggccggctgtgaagtgcttggtgtcgtctcaatctttacgtacggacttcccaaagcggaggaagccttcgcaaaggcagaactgctatactactcattaactgattatgatacgctcacagaggtcgcgcttgaaaacggaaatattcattcagatgatctaaaaaagctgcaaacatggaaacgaaatcccgagtcaaaagattggtttaaaaaataaaaaataaattcaaatgatgtaaagaggcttcaaagccttgctgtacttgaaaacaggctgtgaggcctgtttttttattaatcctataaaaaaagtcgggttgacttatgttagaattgtgctaaaatttactacaaatctaaaaacttatcaagagcggctgagggactggacctatgaagcccggcaacctgcatagtttgtaaggtgctacttccagcaaaatgaattccattttgaaagataagggctgcatgctgttcctgtctttctttccgccggattgaaagttttttattttaagaggaaaaaaggctgtctgtgatatcagcagccgcgaatcacattacaattgggaaaagacaaccggcagaaagctactgtttgtttgtctccgaaaggaggaaagaagaaatgttaacgtacgataattgggaagaaccaacgattacatttccggaagacgatccttataaaggagcgctgtcagttttaaaatgggcatacggccattacggcaatcagcttgtttatgcctgcagtttcggaattgagggaatcgttctgattgacttaatttataaagtgaaaaaagacgcagagattgtgtttcttgatacaggacttcattttaaagaaacctatgaaacaattgaacgagtgaaagagcgttatccgggtcttaatatcatcctgaaaaaaccagacctcacccttgaggaacaagccgaagaacatggtgacaaactgtgggaaagagagccgaatcagtgctgctatcttagaaaggtcgttcctttaagagaggcgctttcaggacatccagcctggctttccggcctgcgccgtgatcaagggccaagccgtgccaatacgaatttcttaaacaaagatgaaaaattcaagtcagtaaaagtttgcccgcttatccattggacttggaaagacatttggagatacacatcccggaatgaactggactacaatccgcttcatgaccaaggatatccaagtattggctgtgcgccttgcactgctcccgcttttactgcagaggatttgcgctcaggcagatggaatggtatggcgaaaacagaatgcggactgcatgaataaggagctgcaaaatggaattagccgctattttatttagcttgtttttcgcgatgaatattggtgcaagcggcgctgcagcttcgatgggggttgcttacggctccggagccatcaaaaagaaaacctacgctttgatcctatgcgcagtcggtgtctttgccggggcggtcattggcggaggcgaggttgtaaaaacaatcagctccggcattattcctgagcagacgattacactgacgattgtttgcatcattattggagctgctgccctgtcgctctttactgctaatctgctcggcattcctttgtcgacaagtgaagtaacagtcggcgcggttgtcggcgtgggagtggcttataaagtattgtttgtgaacaatcttctgatcattgtgtcattttgggtttttgtcccgctgttcgctttcggcttcacctatttcgtatctaagctgtttcgttattttaagattgaagtaaaatcttctaaaaaacaaaaaatcctcggcattgttttgttagttgccggatttttcgaagcattctctgccggcatgaataacgtggcgaatgctgttggcccgttagtagctgccgatgtgcttgatgtcggaaaaggaaccttgtatggaggagcttttgttgctcttggcgcactgttattaggccggcgtgtgctagaaacaaacgggaagaaaattacgagattctccaaaggggaaggcattctcttatccggtacaggagcaggacttgtgatcatcagttctgtatttgggatgccggtgcccttggcgcaagtcacgtcatcgtctattatcggaataggcatggcaaaaaacggtccgaacgtgttccataaacaagttgttcaaacgatgctgaaggtatggatcgtatcgccgtttttatctttatcgatttcttatctgcttgtatccttgtttttaaaagcagattattattcgatctttatcatggtaagtgtgcttttagcggcgggcggtgccatcagcctgacaaaggccattcgtaaagagagacgctcagtccacgaacaaggcgggggaatctgatcattaatctgagtaattttataagttaactaggaggagatggatattatgagcttagcaccacacggaggaacattagtaaacagagtagatgaatcatatgatgtgagcggcattcaaaaagaaattgaacttgatttaatttctttcgcggatttggaattgatcggtatcggtgcatacagcccgattgaaggtttctttaatgaaaaagattacgtatctgttgtcgaaaacatgcgtctttcttccggtgttgtttggtctcttccaatcacgcttccggtcgatgcgcaaaaagcagcggaactgtcacttggtgaaacggtaaagttaacgtatgaaggagaaacatacggcgttatccaaatcgaagacctgtatgtgcctgacaaacaaaaagaagctgtcaatgtgtacaaaacagatgaacaggagcatcctggtgttaaaaagctgttcagccgcggcaatacatatgtcggcgggccgattacgttgattaaaaaagcttcaaaacagttccctgaatttacatttgaaccgttagaaacgagacgccagtttgcggaaaaaggctgggaaaccattgtcggtttccaaacaagaaaccctgttcacagagcgcatgaatacattcaaaaaacggctcttgaaacagtagacggcttgttcttgaatccgttagtaggtgaaacaaaatctgatgacattccagctgatgtacggatggaaagctaccaagtgcttcttgatcattattacccgaaagatcgcgttttccttggtgtctttttagcggcgatgcgttatgcaggcccgagggaagcaattttccacgcgcttgtcagaaagaactacggctgcacacatttcatcgtcggccgtgatcatgcaggtgtaggtgactattacggaacatacgaagcacaggagctgtttgacacatttaaacctgaagaactcgggattacgccgctgaaatttgagcacagcttcttctgtaaaaaatgcggaaatatgggaacagcgaaaacatgccctcatggcagagagcatcacgtcattttatcaggcactaaggtaagaggtatgctgagagacggtgtgctgccgcctgctgaattcagtcgaaaagaagtcgtagaagtgttaatcaaagggatgaagaaaaaagaagaagtaggcgtatcttaaggaggactggcagtgacaaatcgcgatattgtatggcatgaagcctctatcacaaaagaagagtaccagcaaaaaaacaagcataaaagctccattctctggctgacagggttaagcggctcaggcaaatcaactattgccaacgccgctgcgagagaattgtttgagcaaggctaccaagtgattgtgctggacggggataatatccgtcacggcttaaataaggatcttggtttttctgatgaagaccgaaaagaaaacatccgccgaatcggagaggtggcaaagctttttgttcagcagggaaccattgtgattactgcttttatctctcctttccgcgaggacagacaacaggttcgcgagcttgtggaagcgggcgaatttaatgaagtctacattaaatgcgaccttgatatttgtgaacaaagagatccgaaagggctttacaaaaaagcaagaaacggcgagattccgttttttacaggaattgattctccttatgaagaaccggaagctccagagctcgttcttgattcaggacaacatgaccgtgaagcgtgtaaaaatcagctgatcgagtttgttaaacaaaaattgagctgaatatgatctgctgcgttcttctcagatgccggaatgcaagcgagaacatcatcacagcgaatgctctggaagaactcgaatagatcgggggaaatacgatggggaaagtatatattgtaggagcgggtcctggtgaccctgatctgttgacaattaaagcgctgaaagccattgaaaaagctgatgtcatcttatatgacagattagtaaataaagagattttacaatatgccaaagagcaagcagacctgatctactgcgggaagcttccagattttcatacgatgaagcaggaaaccatcaatcgatttcttgtgaagtatgcgcaaaaagggaaaatggttgtcagactgaaaggcggagacccttttgtgttcggcagaggaggggaagaagcggaatgcctctctgaaaatggaattccgtttgaaatcatccccggcattacgtctggaatcgcggcagccgcttatgccgggattcctgttactcatcgggaggcgggctctaacgtcgcttttgtaacgggtcattataaaaaagaagaagattttgaggaaaagtggaaagcgctggctacaggaattgatacacttgtcatctatatgggtatcaaaaacgtgcagcagattgaaagaaaactccttgaaaacggccgggacggttctacgccggcagcctttattcattggggaacaacggacaagcaaaagtctgttttttgtacagttgacaccctttcagaaacggtgataaaagaaaacattacaaatccgagtttaattgtcattggaaatgttgtaaattatcactataagctggaatggtttgaatctgaactgaaaaaacaagatttaagcgaggcgttgtaaaaatgaaacaagcaattttatatgtcggccacggcagccgggtcaaaaaagcgcagcaagaagccacagcctttttggaaggatgcaaggcccacatctctgtgccagtacaagaaatcagctttttagagcttcaggagccggcaattgagacaggatttgaagcatgtgtgaagcaaggcgccactcatatcgcagtggtgcctctgcttcttttaacagctgcgcatgcaaaacatgatattccggaagaaattgcccgtgctgcatctcgatatccgtcagtccgcatttcatacggaaagccgatcgggattgacgaagaagtagtcaaggctgtatatcaccgaatgaaagacataggtgttccatatgaaaatgccagagtggtactcatcggaaggggaagttcagatccagatgtcaaaagagacgtaaccggtattgctaatcttcttcaggaaatggttccagtcaaggaagtcattccgtgctttttgacagcatgcggcccgaattacaaagaggttttttcagaacttaaaaaagatgacggcataacaacctttatcgttccatatttgctctttacgggtatgctgatgaatgaaatcgaacgagaggttcagaaattaaaagctcataatccgaacgtctacctctcttcctatatcggttttcatcctcatgtgaaaaacgcatttttgaaccgtgtgagagaaactgcggcaaattctgagggacaatttgattttgatggagattcatatgcttccgctgcacattagcctggaaaagaagaaggttgtgattgcggggggcggcagcatcgctctcagaaggctgaaatcggtgatttctgagggagctgatataacgctcgtcagtccggatgttgaaccggaaatcaagcaaatggcagaagagcgacgtatcaaatgggaaaaacggacaattgaaaaagaagattatctcaatgctttcttcattattgctgcgacggataatgcggcagtgaacaaagaaattgcccaatccgcttcgccttttcagcttgtcaattgtgtcagtgacgctgagcttggcaatgtatatatgccgaaaattgtaaaaagagggcatgtcactgtgtctgtttctacaagcggagccagtccaaagcacacgaaagagcttgctgaaaacgtggataagctgattgacggcgattttattgctgaagtgaacaggctttatcaggtgagaaggaagaaataagccagagcatacaaatgctctggcttttctttatgcggctcagctttttttgagcttgatgacagtatcagcatcaggcgtgacaaagacggtatgctggctgtcataggtgacgaaaccgggtttcgcgccgtttggttttttgacatgcctgatttttgtataatctacaggcactgaacttgaatctttagcttttgaaaaataagctgcaattgtcgcggcttccatgattgtttgctcatccggttcgctgcttctgatcacaacgtgggagcctggaatgtcctttgtgtgaagccagatatcgtctctggccgccgctctggtcgttaaatattcattttgacgattgttcttacccactaaaatcgtcaggcctgaggtggattcatatgtttctaacaccggattgtgcggtttttgctttttctggcctttttgctgcttagggcgtaaatatttgccctcaacaagctcttccctgatttcgctgatatcccggggagaagcggacgaaagctgctgaaacagctgatcaaaatattcgatctcttcctgtgccagcctgatttgctcctcgacaactgcgaccgaatttttcgctttctgatacttcgtgaaataggcctgtgcgttttcagaaggcgttttgtttgggtttaaaggaatcgtgattgtcgggctttcttcattataataattgatgacctcagcctgtttatcaccttttttcaacatatataaattagcggttaaaagctccccgtaaagctgaaattccttcgcgttttccgaatactccagggttttctctaattttttgattttgttggcattcttcttccgttcgttcacaacaaaacgctcaagatcctgagcctgttgcttgacccggtctcgttcagcttttccgaaataaaaacggtcgagcagttcgcttaatgaatcaaaacggcgcgcttcgccctttagatgagtcagctccagcaggtaaaaatattcctttccgtttacagtcgtaatgttgggaatgaaacggtgctctttcacttcagcaaacagtgccagcaacgcttttggcagtgtgactttgttggcaaggcctgctctgtgaaccgcttctttggcgaaaagcggagacacgcctgaaaagtggtcgacaatttgtttatcaagccttccttcttgaaagctgaggtgacgcaaaatatcatcttctgacgcctcaagaggcgatattttgtcctgagcaggcggaagcttataatcttggccgggcagtactgtacggtagctgttcattgacggtgataagtgcttaagtccgtcgatgatcacattttctgctgcgtcagtcaaaatgatattgctgtggcggcccataatttctacataaagctttcgtacggtttcatcgccaatttcgtttcggcttttgatatgaaaaatcataatgcggtctaagcccgcttgttcaattttctcaatgaatccgccttcgatatgctttctcagcaacatgcaaaacattggcggttcgcttggattttcataagcttgtgccgtgatatgcacccgtgaatagctcggatgtgccgataataatagtttttggttttttccattggcacggatgtggaaaatcacatcgtgcttatatggctgatggacttttgtaattcgtccgcccattattttctcgttaagttcgtgtgtcattccgtatgtaaacatgccatcaaacgacatatgcaatacaccctctcattcttcctgcattcgataattatagcatgaaatgggacgagtcagaataagcatgcttatagagtgatatctctataagagagcaggggagtggacgagcggaatgaagtttcatgaaatgggacaaacagatttactagaggcaaccaatacgtccatgaaacaaggattaacagaaaaagaggtaaaaaaacgccttgacaagcatggaccaaacgagctgcaagaaggggaaaaaacttcagcgcttctcttgtttttcgcgcagttcaaagattttatggtgcttgtgcttctggcggcaacgttaatctcaggatttcttggtgaatatgtagatgcggttgcgattattgcgattgtgtttgtgaatggcatacttggtttctttcaagaaaggcgtgctgagcaatctcttcaggctttaaaagagctttcaacaccgcatgtcatggcactcagagaaggaagctggacaaagattccttctaaggaactggtgccgggtgatattgtgaaatttacgagcggggacagaattggcgcagacgttcgaattgttgaagcaagaagccttgaaatagaagaatcagcgctgaccggggaatcaatcccggttgtgaagcatgctgataaattgaaaaaaccggatgtttcacttggcgatattaccaatatggcatttatgggtacgattgtgacccgcggcagcggtgtgggggttgtcgtcgggacaggaatgaatacggctatggggaaaattgccgacatgcttgaatcggcagggacattgtcaaccccgctgcaaagaagactggagcagctcgggaagattttgattgttgttgcattgcttctgaccgtacttgtcgttgctgtcggtgttattcaggggcatgatctgtacagtatgtttttagcaggtgtctcgttagcggtagcagctattccggaggggctgccggcgattgtgacagtggcgctatcgcttggtgtacagcggatgattaaacaaaaatccattgttagaaagcttcctgctgttgaaacgcttgggtgtgcgtctatcatttgttcagataaaacagggacaatgacccaaaacaaaatgacggtgacacatgtctggtccggagggaaaacatggagagtggcaggggccggctatgaaccgaaaggaagcttcacactaaacgaaaaagagatcagtgtcaatgaacataagccgcttcagcagatgcttctgttcggagcgctttgtaacaactccaatatcgagaaaagagacggcgaatatgtgcttgacggagatccgacagagggagcgctgctcaccgcggcaagaaaaggcggtttttcaaaggagtttgttgaatcaaactaccgggtggtcgaagaatttccgtttgattctgcacggaaaatgatgactgtcatcgtagaggatcaagacagaaagcgctatatcattacaaaaggtgcaccggatgtactgatgcagcgatcttcccgtatttattatgacggctcagcggctcttttttcaaatgaaagaaaagcagaaacagaggcggtattaagacatttggcatcacaggcgctcagaacgatagcggtcgcctacaggccgataaaagcaggcgaaacaccgtcaatggagcaggcggaaaaagatctgaccatgcttggcctttcaggtatcattgaccccccgcggccggaagtcagacaggcgataaaagaatgccgtgaagcaggaattaagaccgttatgattacaggtgatcatgtagaaaccgctaaagcgatagcgaaagacttgcgcctccttccgaaaagcggcaaaatcatggacggcaagatgctgaatgaactttctgaagaagagctttctcatgtggtggaggatgtatatgtatttgcccgcgtttcccctgaacataaactaaaaattgtaaaagcctatcaggagaacgggcatattgtggcgatgacgggagacggcgtcaatgatgctcctgccattaaacaagctgatatcggcgtctctatgggcattaccgggacagatgtggccaaagaagcatcatctcttgttctcgtggatgataattttgcgacgattaaatcagcgataaaagaaggcaggaacatctacgaaaatatcaggaagtttatcagatacctgttggcgtctaacgtcggagaaattcttgtcatgctgtttgcgatgctgctggcccttcctttaccgctcgttccgattcagattttgtgggtcaacttggtgacggacggattgccggcgatggcgctcggcatggatcagccggaaggagacgtcatgaagcgcaagccccgtcatccgaaagaaggggtatttgcccgcaagctaggatggaaggtcgtttccagaggatttttaatcggagttgccactattttagcgtttatcattgtgtaccaccgcaatccggaaaacttggcttatgcccagacgatcgcgtttgccacattggtgctcgctcagcttattcacgtgtttgactgccgcagcgaaacttctgttttctctagaaatccgtttcaaaacctgtatttaatcggcgcggtattgtcatccattttgctgatgcttgtagtaatctactatccgccgcttcagccgattttccatactgtagccatcacgccgggggactggatgctcgtcatcggtatgtccgccatccctacttttttgctggcggggtcacttttaacaagaaaaaaataaattcatatgatataatcttaggggtaatagcgtgtctattgcccttttattatgagaacagggaagaattgggtgttttaaaatgatacgaagtatgacaggcttcggcagtgcaagcaaaacacaagacgatctctctgtaagcgttgaacttaaatctgtgaactacagatttaaagaagtgaacgctcgtttgccaaggcctttgctatattttgaagataagctgaaacagaccattctgcagcatattcagcgcggaagaattgagcttttcgtatccgttgacagcgatatgcttgttgagaaaaggcttgaaattgattggccgctgctcgatgagtttgtcgcagccgcgagaggtatgaagaaacggtatcaattgtctgcagagcccgatgtaatggatttctttaagcttgatcatgtcgtccaggttcatgaagaacagacgcaaaatgacaagctggaggcgttgatcatcgatgctgcagaagaagcggtaaaaggtctctgtgaaatgcgtgaaaaagaggggctgctcttagcgaaagactgcctgatgcatattgatcagcttgaagagctggtgagagaaactgaattgctggctgcagatgtcgtatctcgttaccgggaacggctgtacgccagaatcaaagaatggactgaagacgtattagacgagagccggcttgtaacagaatgcgctatttttgcagaccgctctgatatcactgaagagattacaaggctgaagagccacttcgcccagtttcgtgatatattagctagtggcggagctgtcgggcgcaaactcgactttcttgttcaggagctcaatcgggaagcaaatacgattggctcaaaagcaaatgatcatcagatcacaaagcttgtcgttgaaatgaaaagttctattgaaaaaataaaagaacaagtgcaaaatatagaatagtgactgtgcgtattgtttacagacggtcttactaggctaaactagagacgtctattttacagggggaacgtagaagatgacgattaaactgattaatatcggatttggcaatatcatctccgccaatcggatgatttcgattgtcagcccggagtctgcgccaatcaaacggatgattcaggatgcaagagaccgcggaatgctaattgacgctacatacggacgaagaacccgtgcagttgtcgtcatggatagtgatcacattatcttatctgccgtccagcctgagacagttgcacacagactttctgttaaagaagaaattatggatgaagggcaggggtaattgccgcatgaaagaaagagggttattaatcgttctctcaggtccctcaggagttggtaaaggaacggttcgacaagcgatcttttcgcaggaagacacaaaatttgaatattcgatttcagtaaccacaagaagtccaagagagggcgaagtgaacggagtcgattattttttcaaaacaagagacgaattcgagcaaatgattgcggacaacaagctgcttgaatgggcagagtatgtcggcaattattacggcacgccagtcgattatgttgaacagacgcttcaagatggaaaagacgtctttttagaaattgaagttcaaggggctcttcaagtgagaaatgctttcccggaaggcctatttattttccttgcgcctccaagcctttctgaactgaaaaacagaatcgtgacacgaggcacagaaacagacgctctgattgaaaatcgaatgaaagccgcaaaagctgagatcgaaatgatggatgcttatgactatgtcgttgaaaacgataatgtcgaaacggcttgcgataaaatcaaagcaatcgttcttgctgaacatttgaagcgtgaacgcgttgcaccaagatataagaaaatgctggaggttgaataatcaatgttagatccgtcaattgattctttaatgaataaattagattcaaaatatacgctggtgactgtttctgcgagacgcgcacgtgaaatgcaaatcaaaaaagaccaaatgattgaacatacgatttcacacaaatatgtaggcaaagctttagaagaaattgatgcaggcctgctttcgtttgaaaaggaagaccgcgaatagtagcacaagtagcaacctatatcagatgtaggttgttatttttttccgtgcggttttgtaaagtgcagagggggagaattcattgctaaacaatcgaaatgtgttactttgcgtgagcggaggcatcgctgtttataaagcctgtgcgttaacgagcaagctggttcaggcaggagcaaatgtcaaagtgattatgactgaatccgcttgccgattcgtttcaccgctgacatttcaggcattgagccgccacgaagtctatacagatacatttaaagaacaaaatccaagcgttatttctcatattgatgccgcagactgggccgacttgattattgtagcgccggctacggctaatgtgattggaaaactggcaaacggcatcgctgatgatatgctgacgacaacattgttggcagcaacggctcccgtttggatcgcgccggcgatgaacgttcatatgtatgaccacccggcagtcaaacgaaacatttctgttctttatcaggacggttatcgttttattgagccaagtgagggctatttagcatgcggttacgtaggaaaaggcagattggaagagccggaaaacatcgtaaagctggccgaaaaacattttgctgaagaaacatccgctcctttagaaggcaagcatgtggtcattacagccggtccaacgcgggaagcgattgatcctgtccggttttttaccaataaatcgacgggcaaaatgggctacgcactagcggaggctgctgttcagctcggcgcacgggtaaccttaatttctgggcctgtttcacttgatcagcctaaaggccttgctgagtttatccctgttcaatcggctgcggatatgcgcgaagctgtgctctctgtgtatgacgcaagcgatatagtcattaaaacagctgcggtagccgattttacgccgaaaacagtatttgaccataaaatgaaaaaacaagacggcggcatgaccttagaactgaaaagaacagtcgatattttgaaagaattgggcgagaaaaagaaagagcagattttggtcggatttgccgccgaaacacaagacattgaacactatgcacgtaaaaagctcgccgctaaaaaccttgatttgattgtggcaaatgatgtgaaagcaaatggggccggttttggtgctgatacgaatatcgtgacaatctttttcaaagacgggcataaacgcgaactcccgatcatgtctaagctcgatgtttcttttgaggtccttcaggagatcgcagccctctcaaaacaaaccggagagcgctcatgaattttgcagaagtcatcgttgatgtcagcaccaaaaatatagacaggccttttgattataaaatcccagaccatctcaagggcatgatcaaaacggggatgcgggtcattgttccgtttggcccccgtaagattcaagggtttgtgacagcagtcaaagaagcatctgacctatcgggaaaatctgtcaaggaagtagaggatttattagatcttacacctgttctgacagaggagcttatgattctgtcatcatggctgtcagacaaaacgctgtcttttaaaataacggcgcttcaagcaatgctgcctgccgccttaaaggcgaaatatgaaaaagaattaaaaattgcacacggagccgatcttccgccgcaagtggaacggctgttttctgaaacaaagacgctgctgtattcagatatacccgatcatgagacgctgaaactgattcaaaggcatgttcaaaaaggggacattgacgtgacgtataaagtcgcgcaaaaaaccaataaaaaaatggtcaggcatattcaggcaaatgcgagtaaagaagagcttgctaagcaggctgagggattgtcccgccaagcagcaaaacagcaggcgattcttcactttctcatctctgagccggaaggtgtgaaaattcctgcggcggaattgtgcaaaaaaacggatacgagctctgcaaccattaaaacccttatccaaaaagggcttttgaaggaaagctatgaagaggtttacagagatccctatcaggacaaaatgttcaaaaaaacagagcccctgccgctgacagacgaacagagggctgccttcgagcccatacgcgagacattggacagcgatgagcataaagtgttcctccttcacggcgtgacaggaagcggaaaaaccgaaatttatctgcaatcaattgaaaaagtactggcgaaaggaaaagaagccatcgtcctcgtaccggaaatatcgctgacgccgcaaatggtcaaccgcttcaagggccgcttcggctcccaggtggcagtcatgcacagcggtttatccacaggagaaaaatatgacgagtggcgtaaaatccaccggaaggaagtacggcttgtcgtcggtgccagatccgccatttttgctccgtttgaaaatctcggaatgataatcatcgatgaagagcacgagtcttcctataaacaggaagaaatgccgcgctatcatgcgaaagaggtggcaatcaagcgggctgagcatcacagctgcccggttgtattagggagtgctacgccgacattagaatcatatgctagagcgcaaaagggcgtatacgagcttctttcactgaagcaccgtgttaaccatcgggtgatgcccgaggtttcgcttgtcgatatgagagaggagcttagaaacggcaatcgctcgatgttttcagttgaattgatggaaaagcttgaagaaacgattgccaagggtgagcaggcggtgctgtttttaaataagaggggctactcttcctttgtgatgtgcagggattgcggctatgtcccgcaatgcccgcactgcgacatttccatgacgtatcatcgttacggccaaaggctgaaatgccattattgcggacatgaagagcctgttccgcacacttgtcctgaatgcgcaagcgagcatatccgctttttcggaacgggaacacagcgagtggaggaagagctgacaaaagtgctgccaagtgcgagagtgattcggatggatgttgacacgacatcacggaaaggcgcccatgaaaaattactgtcagctttcggagaaggaaaagcggatattcttctcggaacgcaaatgatcgcgaaagggcttgattttccgaatgtcacgcttgtcggagtgttaagtgctgatacaacacttcatattcctgatttcagatcggctgaaaaaacatttcagctgttaacgcaagtcagcggccgggcaggcaggcatgaaaagcccggccatgtcatcattcaaacgtatacaccgtctcattacagtatccagctgacgaaaacacacgattatgaaacgttctatcagcatgaaatggcgcacaggagagagcaatcctatccgccatactactatttggctcttgtgactgtttctcatgaggaagtggcgaaagcagcggttacagctgaaaaaatcgctcattttttgaaagcaaactgcggagctgacacgaaaattctcggaccaagcgcgtcgccgatagccaggatcaaagatagatatcgctatcaatgcgtgataaaatacaaacaggaaacccagttatccgctttattgaagaagatactggaacattataaacgcgaaattgaacaaaaacatgtaatgatttcaattgatatgaatccttatatgatgatgtaagatctcacgtcttggagggtaacaaattggcagtaaaaaaggtcgtcacacatcctgcggaggttttggaaacacctgcggaaaccgtgactgtttttgataaaaagctaaaaaaactgcttgatgatatgtacgacaccatgcttgaaatggatggtgtcggactggcagcgccgcaaatcggcattttaaaaagagcggccgtcgtagatatcggggatgacagagggagaattgatctcgttaatcctgaaattttagaaaaaagcggcgagcaaaccggaattgaaggatgcttgagctttcctaacgtctatggtgatgtcacacgtgccgattatgtcaaagtgcgtgcgtttaaccgtcagggaaaaccgttcattctggaagcgcgaggctttttagcaagagccgtgcagcatgaaatggaccacttagacggtgtgctgtttacatctaaaataagtaaatactatacagaagatgaactagcggatatggaaggatgatttgatgacgagaatcgtatttatgggaacgccggatttttcagttcctgttttaagaaccctgatagaggacggatatgaagtagtgggggtcgtcacacagccggaccgtccgaagggcagaaaaaaagtactgacacctcctccggtaaaggaagaggcattgcgccacggcatcccggttcttcagccggaaaaagtcagattgacagaagaaattgaaaaagtgctggcattaaagcctgacctgattgtaacggcggcattcggacaaattttgcctaaagagcttctcgacagtccaaaatacggctgcattaacgttcacgcatcccttttgccggaactgcgcggcggtgctccgatccattattccattctgcagggaaagaagaaaaccgggattaccattatgtatatggtagaaaaattggatgcgggcgatatgatctcaaaagtggaagtggacattgaagaaaccgacaatgtcggaacactgcacgataaattaagcgttgctggcgcgaagctattgtctgaaacggttccaaacgttattgccggcagcatatcacctgaaaagcaggatgaagagaaagcgacgtacgcgcctaacattaaaagagagcaagagctgctcgactggtccagaacgggcgaagagctttacaaccagatccgcggcttaaatccatggcctgttgcttatacgactctaaacggacaaaacttgaaaatatgggcgtcgaaaaaaatagcggcaccaacaacagctgagcccggcacagtcgttgcagttgaaaaggaaggaattatcgttgcctcaggtaacgagacggctctgttattaaccgaactccagccggcaggcaaaaaacgaatgaaaggcgaagactttgtgcgaggcgctcatgttgaagccggtgatgtgttaggagtaaacaatgaaaaaaactagtgttcgtgacatcgcccttgaggcgctgatcaaattagaacaaaaccaggcatacagcaacctgctgctgaaatcggtcattaaatcaaatgaactgagtgatcaggacagagggcttttgactgaacttgtctatggtacattacaaaataagatcgcgcttgattatatgcttaaaccgtttatcaataagcctcaaaaggtaaagccgtgggtgattcagcttcttcgcctatccttatatcaaatggagtatttggagaagattccagacagggcagccattcatgaagcggttgagattgctaaaatccgtggacacaaaggcattgcttcatttgtcaacggcgtgctccgttctattcagcgcgaaggtgttccatcctttgacgcgatcgaagatcctgtccgccggctggcgacagaaacaagccatccggaatggcttgtgaaagagtgggcggatgcgtatggatttgaagctgcggaaaagatttgccgcatccatctcattccgccgaaacagacgctgcgtgtcaatcaaatgaaagcagacagagctgagctgcttgaccaaatggctgctgagggaatcgaagttgaaaaaagcgacctcgctgaagatgctgtgaagctcttaaagggaacaattgccggaactcatttcttccaaaacggcgaagtttctatccaggatgagagctccatgctcgtcgcccgcgcccttgatcctaagtcagatgaaacagtgcttgacgcgtgtgcggcgcctggcggaaaatcggctcatatcgcagaattaatgaagaacaaggggagcgttacgtcgcttgatcttcacaaacataaagtgaagctgatcaaagaagcggcagatcggcttggcctgacaatcattcatgcggaaacaatggatgctagaaaagcgggggaaacgtttgaaaacgaacagtttgaccgaatattggtcgatgccccgtgctcaggtttcggtgttatcagaagaaagccggacatgaaatacacgaaaaaacctgacgacagcgcccgtctagctgaaatccagctgtcgatcttgagggaaatcgcaccattagtaaaaaaaggtggcactcttgtctacagtacgtgtacaatggaccggacagaaaatgatgaagtaatacatgcgtttatacaagaacatcctgattttgaacccgatttgtctcttgaaaagcggctgcctgaaaaggtgagaccctttgttcgggatggaaggcttcaaatccttcctcattatttcggaacagatggtttctttatttgcagcatgagaaagaagggataagcaatggcagaacttaataaaacaaaagtaagaaaagaattgcggacagagcgtccgtctatttattcttttgaattagatgaaatcaaacaatggctgacagacaatggagagaaaccgttccgtgcagcccagatctttgaatggctatatgaaaaacgcgtatcttcttttgaagatatgacaaacctctcaaaggatctgcgtgagaaattaaacactcactttgtgttaacaacgctgaaaacggctgttaaacaaacctctcaagacggtacgatgaagtttttgtttgagcttcatgacggttataccatcgaaaccgttttaatgagacacgagtatggcaattctgtatgtgtaacgacacaagtcggctgccgtattggctgcacattctgcgcgtcaacgcttggaggcttaaaacgaaaccttgaagcaggggaaattgtcgctcaagtagtcaaagtgcaaaaagctcttgatgaaacggatgaacgcgtcagctctgtcgtgatcatgggaatcggcgaaccttttgataactttaacgaaatgctcgctttcttgaaaatcattaaccatgacaagggcctgaatatcggtgctcgccatattacggtctctacgagtgggatcatcccgaaaatttacgaatttgctgatcagcaaatgcagattaactttgcaatttctctgcacgcgccgaacacagaaatcagaagccgtttgatgccgattaacagagcatataaactgcctgatctaatggaagccgttaaatattatattaataaaacgggacgccgcatcagctttgaatacgggctgttcggaggcgtaaacgaccaggtggaacacgccgaagagcttgccgacttgctggaaggagtcaaatgccacgtgaacttgattccggtaaactacgtgcctgaacgggactatgtgcgcacaccgcgtgatcagatttttgcttttgaaaaaacgctgaaatcccgcggagtaaatgtcacaatccgaagagagcaaggacatgacattgacgcagcctgcggtcagcttcgcgcgaaggagcgtcaagacgagacgaggtgatgagggttgttaacagccttaaaaacagatacaggaaaaatccgccagcataatgaagatgatgcggggatattcaaggggaaagatgaatttatattagcggttgtcgctgatggcatgggcggccatcttgctggagatgttgcgagcaagatggctgtgaaagccatgggggagaaatggaatgaagcagagactattccaactgcgccctcggaatgtgaaaaatggctcattgaacagattctttcggtaaacagcaaaatatacgatcacgctcaagcccacgaagaatgccaaggcatggggacgacgattgtatgtgcgctttttacggggaaaacggtttctgttgcccatatcggagacagcagatgctatttgcttcaggacgatgatttcgttcaagtgacagaagaccattcgcttgtaaatgaactggttcgcactggagagatttccagagaagacgctgaacatcatccgcgaaaaaatgtgttgacgaaggcgcttggaacagaccagtcagtcagcattgacacccgttcctttgatatagaacccggagacaaactgcttctatgttctgacggactgacgaataaagtggaaggcactgagttaaaagacatcctgcaaagcgattcagctcctcaggaaaaagtaaacctgcttgtggacaaagccaatcagaatggcggagaagacaacataacagcagttttgcttgagcttgctttacaagttgaagagggtgaagatcagtgctaatcggcaagcggatcagcgggcgttaccaaattctccgcgttataggcggcgggggaatggccaacgtgtatttagctgaggatatcattctagaccgtgaagtcgcaattaaaatcctgcggtttgactatgcaaatgacaatgaatttatcaggcgtttccgcagagaagcccaatccgcatcaagcctcgatcacccgaatattgtcagcatttatgatttgggcgaggaagatgatatttattatattgtcatggaatacgttgaaggcatgacgcttaaagaatacataacagcaaatgggccgcttcaccctaaagaagcgctgaacatcatggagcaaattgtctcagccatcgctcatgcccatcaaaaccagattgttcacagagacatcaagccgcataacattttgattgatcatatgggaaatatcaaagtaacggattttggaattgcgacggcactaagttcgaccacaatcacccataccaattcagttctgggctcggtccattacttatcacctgaacaggcccggggcggcttagccacaaaaaaatcggatatttatgcgcttggaatcgttctatttgagcttttaaccggccgtattccgtttgatggagagtcagcagtcagcatcgccttgaagcatcttcaagcggaaactccttcggcaaaaaggtggaatccatcggtcccccaaagcgttgaaaacatcatactcaaggcaactgccaaagatccttttcatcgctacgaaacggctgaagacatggaagcagacataaaaacagcttttgatgccgacagactcaatgaaaagagatttacgattcaagaagatgaagaaatgacaaaagcgatacctatcattaaagatgaagaacttgctaaagctgctggcgaaaaagaagctgaagtgacaaccgcacaagaaaacaaaacaaagaagaacggcaaaagaaaaaagtggccgtgggttttgctcacgatatgcctcgtttttatcacagctggaattcttgctgtcactgtttttccgtcgcttttcatgcctaaggatgtcaaaatacctgatgtctccggaatggaatacgaaaaagccgcagggctcttggaaaaagaaggtttacaggttgattccgaggtgttggaaatctcagatgaaaaaattgaagagggcctgatggtaaaaacggatcctaaagcggataccacagtcaaagaaggcgccacggtcaccctttataagagcaccggaaaagcaaaaacggagatcggtgatgtgacaggccaaacggtcgaccaggcaaaaaaagcgttgaaggaccaagggtttaaacatgtaacggtaaatgaagtgaatgacgagaaaaacgcgggcactgtcattgaccaaaatccttcagcagggactgagcttgtcccgagtgaagatcaagtcaaacttacagtcagtatcggacccgaagacattacgcttagagacttgaaaacctacagtaaagaagcagcgtctggatatctggaagacaacggattgaagcttgtagaaaaagaagcatactcagatgatgttccagaaggacaggttgtcaaacaaaaaccagcagcaggtacggcagtaaagccgggaaacgaagttgaagtgacattctctctcggaccagagaaaaaacctgcgaaaacagtgaaagaaaaggtcaagatcccctacgaaccagaaaatgaaggggacgagcttcaagtgcaaatcgcggttgacgatgcggatcacagcatctctgacacttacgaagaatttaagataaaagagccgactgaacgaacgatcgaactaaagattgaacccggccaaaaagggtactatcaagtaatggtaaacaataaagttgtcagctacaaaaccattgagtatccaaaagatgaataacaaggagggaaaatatgcctgagggcaaaattattaaggcgctaagcggcttttactatgtactggatgaatcagaggattcagataaagtaatacaatgcagaggaagaggcattttcagaaaaaacaaaattacccctcttgtcggtgattacgttgtgtatcaagctgaaaatgacaaagaaggatatctaatggaaattaaagaaagaaccaacgagcttatcaggccgccaatttgcaacgttgatcaagcggtcctggttttctcagcggttcagccttctttcagcacggcattgctcgaccgcttcctggttctcgttgaggccaatgatattcagccgattatatgcattactaaaatggatctgattgaagatcaagatacagaagatacgatacaagcctatgcagaagactatcggaatattggttatgacgtataccttacctcctctaaggaccaagacagtttaacggacatcatcccgcattttcaggataaaacaacggtatttgccggtcagtccggtgttgggaaatcctcgcttctcaacgcgatcagtccggagcttggattaagaacaaacgagatttctgagcatttgggccgcgggaaacacacaacccgccacgtggagctgattcatacgtccggaggtttggttgcagatacaccaggattcagctcgcttgaatttacagacattgaggaagaagagctgggctataccttccctgatatcagagaaaaaagctcttcatgcaaatttagaggctgtttacatctgaaagagccgaaatgcgcggtgaaacaagctgttgaagacggagaattaaagcagtatcgctatgaccattatgttgaatttatgacggagattaaagacagaaagccgaggtattagcataatgataaaggttgcaccatctattctttccgctgattttgccgctttaggcaatgagattaaagatgtagaaaaaggcggagccgattgtattcatattgatgttatggacggccgttttgtcccgaatatcacaatcggtccgctgattgtagaagcggtccggccggtaacggatctgccgcttgatgtccatttaatgatagaagagccggatcgttatatcccggcttttgcgaaagcaggcgcagatatcctgtctgtgcatgctgaggcatgtccgcacctgcaccgtaccatccagctcattaaagagcaaggagtgaaggccggagtagttctaaacccgcatacccctgtacaagtcatcgaacatgttttcgacgatcttgatcttgttcttttaatgacggtgaacccgggcttcggcgggcagaaatttattcattcagtccttcctaaaataaaagaggttaagcgaatggcggatgaaaaaggaaaaaaagatctgttcattgaagtagacggcggcgtcaacaaagaaaccgctccgctcgtcattgaagcgggcgcaaatttactcgttgccggttcagctgtttatggccagtctgaccgcaaaaaagcaatttctgaaatcagaggaagtaaataagcagctttagaaaagagctgggcatacaatagcctaagctctttttcctgtatgcagagaaaggaatcagagatgaaaacaattaatatcgttgcgggaggcccgaaaaatctcattcccgatctaaccggctatacggatgaacacacgctttggatcggtgttgacaaaggcaccgtcactctcttagatgccgggatcattcctgttgaagccttcggagattttgacagcataacggagcaagaacgccggcgaatagaaaaagccgctcccgcccttcatgtgtatcaagcagaaaaagatcaaacagatttagacctcgcccttgattgggcgctggaaaagcagccggatattattcagattttcggcattacaggcggcagagctgatcattttttaggaaacattcagctactgtatagaggtgtaaaaacgaacataaaaattaggctgatagacaaacaaaatcatattcaaatgttccctcctggtgaatatgatattgagaaggatgaaaataagcgatatatctccttcataccgttttccgaagacatacatgagctgaccctgaccggttttaaatatcctctaaataattgtcatattacgctcggttcaacactatgtattagtaacgaactcattcattcacgaggtactttttcgtttgcaaaaggcatattaataatgataagaagcacggattaagcatgtgctttcattcaattgctaaaaacaatgaacaaggcggttacgggacgttataggaggggacaaaaatgaaattttacaccattaaattgccgaagtttttaggaggaattgtccgggcgatgctgggctcatttagaaaagattaatgcccaggggttcaaagccctctttcaccacataaaaacgcctgccacatatcggggcaggcgttcattttgttatacacgctcaactttaccggatttcaaagctcgagcagatacatatacttttttaggttttccgttcacaaggatacgaaccttttgaagattcgcgccccaagtgcgcttagaagcgttcattgcgtgagaacggttattcccagctgttgtttttttacctgtgataacgcatttacgtgccatttgtttccctcctcacttgcacaaaacatctactttttaacattcatataatcttagatgctttcgatatggatactttaaataatttaccacagctaaaaaacgtttgcaactattgtttcatcatctttcaagaaaattcacttgacatcttgcggaaacagcagcgctatagtatatgtagaggtacggccagcgattattgcctggtcttttcataatggaaaccatatagtagaatagctgtaactctatgcattcgaaggaggaactagtgtgtccattgaattaagaacgaagtacggacagattgatatatctaatgaagtcatcgcgatggttgcaggaggcgcggcggttgactgttacggcattgtcggtatggcctctaaaaaccagattaaagacggactgactgaaatccttcggaaagagaatttcagcaggggtgtccaagttcgccaagaaggagaacagatacatatcgacatgtatatcattgtcagctacggcacgaaaatttctgaagtggcacataatgtccaaacaaaagtaaagtacacagtaaatcaaaccatcggactggcagtggattctgtcaatatttatgtccaaggcgtacgagtgacgaacccgtagttaggaggagtaggattgtctatcagaacattagacggcagaacctttgccgagatgattcttgcgggagcgcagaatctgtctcaaaacgccagtgcagttgatgcactgaacgtgtttccggtgccggacggtgatacgggaacaaatatgaacctgtcgatgacttccggagcaagagaagttgaacaaatggatacggatgatatcgggaaggtgggctccgcgttatctaaagggctgctcatgggagcacgcggaaattcaggagttatcctatcccaattgttccgcggatttagcaaaagcattgaaacgaaaaaagaaattaatgcacttgagtttgccgctgcgctgcaagcaggtgtagacatggcgtataaagctgtcatgaaacctgtagagggcaccattttaacagttgcaaaagacgctgcaaaaaaagcgatgatcttagcagaaaaagaaaccgatatcactgcgctgatgattgcagtgacagaagaagcagaggcgtctttaaaccgcacccctgaattgctacctgtcctaaaggaagtaggagttgtcgatagcgggggcaaaggcctgctctgtgtgtatgaaggtttccttgcttcattaaaaggtgaaactgtacctcagaaagcagttcttccgtcacttgacgacatggtcagcgcagagcatcacaagagcgcgcaaagcatgatgaataccgaagatattgaatttggattctgtaccgaagtgatggttaggcttgatcagacaaaaagagagttcgacgaaggcacgttcaggcaagacctcagccagttcggagattctctgcttgtgattgcggatgaatcgctggcgaaggttcatattcatgctgaagagccgggaaacgtgttaaactacgcccagcattacggtgaattgatcaaaataaaaatagaaaatatgagagaacagcatacctctatcatcagtcaagaaagcaaacctgcagacaacgaaataccgccggcaaagcagccgtatggcattgtgactgtggcgatgggagaaggaatttcagacctattcaaaagcattggcgcttctgttgtgattgaaggcggccagaccatgaacccaagcactgaggatattgttgatgccgtgaagtctgtaaatgcagatacggtatttatcctgcctaacaactccaacattatcatggctgctaaccaagcggccagcgtagtggatgaacaggtttttgtcattcctgctaaaacggttccgcaagggatgtcagccctgctggcttttaacccggatcaagaagctgaagcgaacgaggccaatatgctaagcgccattcagcaagtaaaaagcggacaggtgacgttctcagtcagagatactcatattgacggtaaagatattaaaaaaggcgactttatgggcattctgaatggaacgattatcggcacttctgaaaatcagctgtcagccgcgaaaatgctgctgtcagaaatgatcggagaagatgatgaaatcgtgaccattctatatggtgaggatgcgtctcaggaagaagctgagcagcttgaagcgtttctcagtgaaaagtacgaggagattgaggttgagatccacaatgggaaacagcctctgtattcgtatatagtttctgcagaatagaagggcaatttgcccttctattcttatgtctgcttttaagtgcggcagcgctgtaacgcgcccgcttgccattttatatctgatcaattagtctagaagcaaagcgctaataagctctggttcataaggaggaatagcatgaaatacagaagcgtttttgatattatcggcccggttatgatcggtccgtccagctctcatacagcgggagctgctagaatcgggagagtggccagaagtttatttggcagagagcctgagcgcatcattgtatctttttacggctcgtttgcggaaacgtataagggccacggcacagatgtcgcgattatcggcggattgcttgattttgatacattcgatgaacggattaaaaccgctatacaaattgcagaagctaaaggaattgatatagagtttcgggtagaagacgcagtcccggtccatccgaacacagcaaaaatcaccatttctgatgaaaagggtgagcttgaactgacgggtatttcgattggcggaggaaagattgaaatcacagaattgaatggttttgagctccggctgtcaggaaatcatccggccatattagttgttcataatgacaagtttggcacaattgccggtgttgccaatgttctggcgaaattttcaatcaacgtaggacatatggaagtagcccggaaagatatcggccagcttgcgctgatgacaatagaggtcgaccaaaatattgacgaccacattctcgacgagctgtcgaaactgccgaatattattcaagtgacaaagattgctgactagcgaaaagggtcaggaggagccagttatgtttcgtaatgtaaaagaattaattgagattactaaagaaaaacaaatattgatctctgatgtgatgatagctcaagagatggaagtaacagaaaaaacaaaagaggacatttttcagcagatggatcataacctgtctgttatggaagcggcggttcagaaaggactcgagggagttacgagccaaacgggcttaacaggcggagatgccgttaaattgcaggcctatattcgatcaggaaaaagcctgtctggcccgctgattttagatgctgtatcgaaagccgttgcaacaaatgaagtaaatgcagccatgggaaccatctgtgcgacaccgactgcaggttctgccggtgtggtgcccggtacgttatttgctgtaaaagaaaagctgaatccaacaagagaacaaatgatccgctttttgtttacagccggggctttcggatttgtcgtggccaataacgcaagcatttccggcgccgccggaggatgtcaggcagaggttggatcagcttcaggcatggcggctgcggctattgttgaaatggcaggaggaacacccgaacaaagcgcggaagccatggccattacattaaaaaatatgctaggcctcgtgtgcgaccctgttgcagggcttgttgaggtgccttgcgtgaaacggaatgcgatgggcgcgtcaaatgcaatgattgccgctgatatggcattggcgggcattacaagccgtattccatgtgatgaggttatcgatgccatgtataaaataggccaaacgatgccaactgcacttagagaaacaggccagggcggtttagcggcaacaccgacaggaagagaattagagaaaaaaattttcggaggagcgctaggttcacgtgaaacaacatcagcaaactagtatagctaacattaagggtattgggccggaaacagaaaaaacattacacgaactcggtatttatgacatttctgatcttctgaattatttcccttatcgctatgatgactacgagctgagggatttagaagaagtaaagcatgatgaaagagtcacagtcgaagggaaggttcattcagagccttctcttacctattacggaaaaaaacgaaacaggctgacattcaggcttctggtcggccactatttaatcacagccgtatgttttaaccggccttatttgaagaagaagctttcgctcggctctgtggtgacggtttcaggtaaatgggacaagcaccgccaaaacatctctgttcaggagttgaaaaacgggccgcatcaagaagacaaaagcattgaaccagtgtattctgtgaaagaaaatgttaccgtcaaaatgatgaggcgctttattcagcaggcgctgacccaatatgcagactcacttcctgatcctcttccggaaaagctaagaaaaagctataaactgcctgactattatcaagcgttaaaagcaatgcaccagcctgaaacaagggaagcattaaagcttgccagacggcggtttgtttatgaagaatttttgttgtttcagttgaaaatgcaggcgttccgaaaggcggaaagagagcagacacaagggatacggcagcgtttttcaaacgaagaactcatgagatttatcaaaagcctcccgtttcccctcacaaacgcccagtcacgcgttcttcgcgaaataacagcagacatgtcttctccatacagaatgaaccgccttcttcaaggggacgttggatcaggaaaaacggcagtcgccgccattgcactgtatgccgcgatcctatccggataccaaggagcgctcatggtgccgacagaaattctggccgagcagcatgctgattcgctcgtttcgctatttgaaaaatgggacgtcagcgttgctcttttgacaagctctgttaaagggaagcggcgaaaagaactgcttgagcgtcttgcggcgggtgagattgatattcttgtaggaacccacgctttaatccaagacgaggtggagtttaaggcgctgagtctcgttattacagatgaacagcacagatttggagttgagcagcgcaaaaagcttcggaacaaagggcaggatcccgatgttctctttatgacagccactccaatcccaagaacattagcgatcacagtgttcggtgaaatggatgtatctgtcattgatgagatgccggctggacgaaagagaatcgagacctattgggtaaaacatgacatgctggatcgtatattggcatttgtcgaaaaagaattaaagcaaggcaggcaggcttatatcatctgtccgctgattgaagaatcagacaagcttgatgtgcaaaacgctattgacgtgtacaatatgctttctgatatttttcggggaaaatggaatgtcggccttatgcatggaaagctgcattccgatgaaaaagaccaggtcatgagagaattcagcgcaaatcactgtcaaattctcgtatcaaccactgttgtggaggttggcgtgaatgttccgaatgcaacgattatggtgatttatgacgccgaccgttttgggctatcacagcttcaccagctgcgcggccgtgttggacggggtgagcatcaatctttctgtattctgatggctgatccaaaatcagaaacagggaaagaacggatgaggatcatgtcggaaaccaatgacggtttcgagctgtctgaaaaggatctggaactgagaggtcccggtgatttcttcgggaaaaaacaaagcggaatgccggaatttaaagtggcggacatggttcatgattacagagcgcttgaaacggcaaggcaggatgctgcgaatcttgtggcttctgacgcgttctggaaggagccggaatacgctgtgttaagagatgaattgctgaagagcggagtaatggacggggaaaaattaagctgagtatcagaagtttttggtgttcagccagaaacaatcgttgcattccaatctatgaaattatatactactattagtacctagtcttaattgtccggatggtgtttagatatgagaagaaataagagagaacgccaggaattacttcagcagacgattcaagcaaccccctttattacagatgaagaactagcgggtaaattcggggtgagcatccagacgatacgtttggaccgcttagagctttccatacctgaactgagagaaagaattaagaacgtggcagagaaaacacttgaggacgaagtgaagtccctgtcacttgatgaagttatcggagaaattattgaccttgagctggatgatcaggcgatatccattttagaaataaaacaggagcacgtgttcagccggaatcagattgcgagaggacaccatttatttgcacaggcgaattctttggccgttgcagtcattgatgacgagctggcgctgactgcaagtgcagacatccgctttacaagacaggtaaagcagggtgaacgtgtcgtagcaaaagcgaaagtgacggctgtcgaaaaaggaagaacggttgtcgaagtgaacagctacgttggcgaagaaattgttttttctggacgctttgacatgtatcgttcaaaacattcataaaggtggagcatgcatgagaatagctgtagatgcaatgggaggagaccacgctcccaaagctgttattgacggagttataaaaggtatagaggcatttgatgatctccatatcacacttgtcggtgacaaaacaacgatagaatcacatttaacaactacatcagatcgcatcacggtgctgcacgcagatgaagtgattgagcctacggatgaaccggtccgtgccgtgcgaagaaaaaagaactcatctatggttcttatggcgcaggaggttgcggaaaacagagctgacgcctgcatttcagcaggaaataccggtgcattaatgacagccggtctctttattgtcggaagaattaaaggaattgaccgtccggcgcttgccccgacacttccgactgtttcgggagacggatttcttctccttgatgtcggcgccaatgtcgatgccaaaccggagcacctcgttcaatatgccatcatgggttctgtttattctcagcaagtgcgcggtgtcacttcaccgagagtcggacttttaaatgtcggaacagaagataaaaaaggaaacgaactgacgaagcagacgttccaaattttaaaagaaacagcaaacatcaattttatcggaaacgtggaagcgcgagaccttttagatgatgtggcggatgttgtagtaacagacggctttaccgggaatgttacactcaaaacgctggaaggctctgcgttgtcaatttttaaaatgatgagagacgtaatgacgtctactttgacatccaagcttgcagcagctgtgctgaaaccaaaattgaaagaaatgaaaatgaaaatggagtattcgaattatggcggagcaagtctttttggcttaaaagcgcctgtgatcaaggcgcacggctcttcagattcaaatgctgtattccatgcgattcggcaagcaagagagatggtcagccaaaatgtggctgcgctcattcaggaagaagtgaaagaagaaaaaacagatgagtagtctggaggtttttacatcatgagtaagattgcatttttattcccgggtcagggatcacaatttatcggcatgggaaaagagctttatgagcaggtgcctgctgcaaagcgtctgtttgatgaagccgatgaaacgttggaaacaaaactcagctcgcttatttttgagggggatgctgaagaattaacacttacatacaatgcgcagcctgctttgcttacgacaagcatcgctgttcttgagaaatttaaagaatctggcattacacctgatttcacagcaggacacagccttggtgaatattctgcactggttgcggctggcgctctgtctttcaaagatgctgtttatactgtcagaaagcgcggagagtttatgaatgaagcggtgccggctggcgaaggagcaatggctgcgattctcggcatggatgctgaagcattaaagcaagtaaccgataaagtcacagaggaaggcaaccttgtacagcttgcgaatctcaactgtcctggccaaatcgtcatttccggaacagctaaaggggttgagcttgcatctgaactggcaaaagagaacggcgcaaaacgcgcaattccgcttgaagtaagcggtccgttccattctgaactgatgaaaccggctgctgaaaagctgaaagaggtattggacgcctgtgacataaaagacgctgccgttccggtcatctcaaatgtttctgctgacgtgatgactgaaaaagcagatatcaaagaaaaacttattgagcagctttactctccggttcgttttgaggaaagcattaacaagctgatcgcagagggtgttacgacttttattgaaatcggtcccggaaaagtgctttcaggccttgtgaaaaaagtgaatagacggttaaaaacaattgctgtatcagatccggaaacgatcgagctggcaattcaaacgcttaaggaggagaatgataatgcttaatgataaaacggctattgtcactggcgcatcccgcggaatcggccgctcaatcgcccttgatctggcaaaaagcggagcaaatgttgtcgtgaactactccggcaatgaagcgaaagcaaatgaagtggttgatgaaatcaaatcaatgggcagaaaagcaattgctgtcaaagcggatgtatcaaatcccgaagatgtacaaaacatgataaaagaaacattgtctgttttttctacgattgacattctggttaataatgcgggaattacaagagacaatctcatcatgagaatgaaagaagatgaatgggatgatgtcattaacattaacctgaagggtgttttcaactgcacgaaagctgttacaagacaaatgatgaaacagcgttcaggccgcattattaacgtatcgtctatcgtcggcgtcagcggaaaccctggacaagccaactacgtggctgcaaaagctggcgtcatcggtttaaccaagtcttctgctaaagagctcgccagccgaaatattacggtaaacgcaatagcgccaggatttatctcaactgatatgacagataaacttgcaaaagacgttcaagacgaaatgctgaaacaaattccgctcgcgcgctttggtgaacctagcgatgtcagcagtgttgtcacgttcctagcttcagagggagcccgttatatgacaggccaaacgcttcatattgacggcggaatggtgatgtaagttttttctcgaaaatttcatcgtagtttctctagttttttaaaaacgaatccactataatacttgaggggaggtgaattgctatggcagacacattagagcgtgtaacgaaaatcatcgtagatcgccttggcgttgatgaagcagacgtcaaacttgaagcttctttcaaggaagacttaggtgctgattccctagatgtagttgagcttgttatggaacttgaagacgagtttgatatggagatttctgacgaagatgctgaaaagattgcaacagtcggcgacgctgtgaactacatacaaaaccagcaataagctgatgctaaaagtcccgccgaaacgcggggctttagccctttattcgtgcagttattacagcatgccgcttttacgcgcgctgtatccggtttagtcagagaagcgcggtgaacctgatgtgcctatggaggttactatgtcaaaacactcacattataaagataaaaaaaagttctataaaaaagtagaacaatttaaagagtttcaagaacggatttcggttcactttcaaaatgaaaagcttttgtatcaagcatttacacattcatcttatgtgaatgagcatcggaaaaagccgtatgaagataatgaaaggcttgaatttttaggtgacgctgttttggaactgacgatctccagattcttatttgccaaatacccggctatgagtgaaggagatttgacgaaattgagagccgcaattgtttgcgaaccgtctctcgtttcattggctcacgagctgtcattcggcgatcttgtcctgttgggtaaaggcgaggaaatgacaggcggaagaaagcgtcctgctctattggcggatgtttttgaggcatttatcggagccttgtaccttgaccaaggattagagccggtcgaaagtttcttaaaagtttatgtgttccctaaaattaacgatggtgctttttctcatgtgatggatttcaaaagccagctgcaggaatacgtgcagcgggacggcaaaggctctctggagtataaaatctccaacgaaaaaggacctgcgcacaaccgtgaatttgaagccatcgtatctctaaaaggtgaaccactcggagtcggaaacggccgttcaaagaaagaagccgaacagcacgctgctcaggaagctttagctaaattgcaaaaacaccatacgaaacaataaaatcccccttatgactcagggggatttcagtatgtatgccgtcttatttgaccaatgtttatgatagaattgaaatacttattacataaggaggatcgctatgttcctcaaacgtttagacgttataggatttaaatcatttgcagaacggatttccgtagacttcgttaaaggcgtgacagcagttgtcgggccgaacggaagcggaaaaagcaacatcacggatgccattcgctgggttctcggcgaacaatcggcacgctctcttcgcggcggaaaaatggaagacatcatttttgccgggagtgattcaagaaagcgattaaatctagctgaagttacgcttactcttgataatgatgatcatttcttgccaattgacttccacgaggtgagtgtcacaagacgtgtgtacagatcaggtgagagtgagtttctgattaacaatcagccatgccgcttgaaagatattattgatttatttatggactctgggcttggtaaagaagcattttctattatcagccaagggaaagtggaagagatcctgagcagtaaagcggaggatcgccgcagtatctttgaagaagcggccggggtgcttaaatataaaacgagaaagaaaaaagcagaaaataaactgtttgagacacaggacaatctaaatcgggtagaagatatattacatgagcttgaagggcaggttgaacctcttaaaattcaagcttcaatagcgaaagactaccttgagaaaaagaaagagctggagcatgttgaaattgcgctgactgcctatgatatcgaagagctgcatggtaaatggtcgactcttaaagagaaagtgcagatggcaaaagaagaagagcttgctgaatcgtctgctatttctgcgaaagaagcaaagattgaggatacaagggacaaaatacaagcgcttgatgagtcagtagatgagctccagcaagttttactggtaactagtgaagagctggaaaagcttgaaggccgtaaagaagtcctgaaagaacgaaagaaaaacgctgtgcaaaaccaagaacagcttgaagaagccatcgttcagttccagcaaaaagaaacggttctgaaagaagagctttcgaagcaggaagctgtcttcgaaacgcttcaggctgaggtgaagcagttaagggcgcaagtaaaagaaaaacagcaggctctcagtcttcacaatgaaaatgtcgaagagaaaatcgagcagctgaaaagtgattattttgagctgttaaacagccaggcttcgatacgcaacgaactccagcttcttgatgaccagatgtcccaatccgctgtcacattgcagagactcgcggacaacaatgaaaagcacctgcaggaacggcgtgatatttctgcgcgtaaagccgcatgtgaaacggaatttgcccgaattgagcaggagattcacagtcaagtcggtgcatatcgtgatatgcagacaaaatatgagcagaaaaagcgccaatacgaaaaaaatgaatccgctctgtatcaggcataccaatacgttcagcaagcgagatcaaaaaaggacatgcttgagacgatgcagggagatttctccggcttttatcaaggtgttaaagaagtgctgaaagcgaaagagcgccttggcggaattcgcggagcggttcttgagctgatttctacagaacagaagtatgaaacggccattgaaatagcgctcggcgcttctgctcaacacgtcgtgaccgacgatgaacaatctgcccgaaaagcgattcaatatttaaagcagaattccttcggccgggcgacgtttctgcctctttctgttattagagaccgccagcttcaaagccgtgacgcggaaacagccgcccggcattcatcatttctcggggttgcaagtgaacttgtcacatttgatcctgcgtatcgaagcgtcatccagaatcttcttggaaccgttctgatcacagaggacttaaagggtgcaaacgagcttgcgaagcttctcgggcaccggtaccgcatcgtaacccttgagggagatgttgtgaaccccggtggttcaatgacgggcggcgcggttaaaaagaaaaataactccctcctcggaagaagccgggagctagaagatgtgacgaaacggctcgctgaaatggaagagaaaacagctctgcttgaacaagaggtcaaaacccttaaacaatccattcaggatatggagaaaaaactggctgacttaagagaaaccggggaaggcttaaggttaaagcagcaggatgtgaaaggccagctgtacgaacttcaagttgccgagaaaaatatcaatacccatttagagctctatgaccaagaaaaatctgctctgtcagaaagcgatgaagagaaaaaagcgcgcaaacgcaagcttgaagaagagctctctgccgtatctgaaaagatgaaacagcttgaagaggacatagacaaactgacaaaacaaaaacaaacgcaatcctcaacgaaagagtctctttccaacgagcttactgagctgaagatcgctgcggccaaaaaagagcaggcatgcaagggggaagaggacaaccttgccagattaaagaaagagctcactgaaacagagattgcgttaaaagaagcaaaagaagacttaagcttcttaacgtcagagatgtcatctagcaccagcggcgaagaaaagctggaagaagcagcaaaacataaattgagtgacaaaacgaaaacgatcgaactgattgcattaaggcgcgatcagcgcatcaagcttcagcatgggcttgatacgtatgagcgtgagctgaaagaaatgaaacgcctgtataaacaaaaaacaacgctcttaaaagacgaagaagtcaaactcggacgaatggaagtcgagcttgataatttactccaatatttacgggaggaatacagcttgtcctttgagggggcaaaagagaaatatcagcttgaaactgatccagaggaagccagaaagcgcgtgaagctgattaaactcgcaattgaagagctgggtaccgtgaacctcggaagcatagatgagtttgagagggtcaacgaacggtacaagtttctgtcggaacaaaaagaagatttaacagaagcgaaaaataccttgttccaagtgattgaagaaatggatgaagaaatgacgaagcgctttaacgacacattcgttcaaatccgctcacactttgatcaagtttttcgctccttattcggaggagggcgagctgaactgaggctcaccgatcctaacgatctgcttcattcaggagtcgagattatcgctcagccgccggggaaaaagctgcaaaacttaaacctcctgtcaggcggagagcgtgcgcttactgctatagcgctcttattctcaatcctaaaggttcgtccagtgccgttttgcgtccttgacgaagtagaggctgcgctcgacgaagcgaatgtgttccggtttgcgcagtatttaaaaaaatacagcagtgatacccagtttattgtgattacccacagaaaaggaacgatggaggaagcggatgtgctttatggcgtaaccatgcaggaatccggtgtttccaaggtaatctccgttaagctggaagaaacaaaagaattcgttcagtaacgaggaaagaggttaaaagatgagcttttttaaaaaattaaaagagaaaatcacaaaacagacagattccgtatctgaaaagtttaaggatggccttgaaaaaacaagaaactcctttcaaaacaaagtgaatgatcttgtatcccgttaccgtaaagtggatgaggatttcttcgaagagcttgaagaggttcttatcagcgcggatgtcggttttacaaccgttatggaattaatagatgagctgaaaaaagaagtcaaacgcagaaatattcaagatccaaaggaagtccagtcagtgatttctgagaaactggtcgagatttataacagcggagatgagcaaatttcagaactgaacatccaggatgggcgtttaaacgtaatccttctggtaggtgtaaacggtgtcgggaaaacaacaacgatcggaaagcttgctcataaaatgaaacaagaaggaaaatctgtcgtacttgccgccggagacactttcagagcgggagccattgaacagctggaagtatggggagagcgtacaggagtgcctgtcattaagcagacggccggaagcgatccggcagctgtcatctacgatgctgttcatgctgcgaaagcaagaaatgccgatgtattaatttgtgatacggcagggcgtctccaaaacaaagtaaatctcatgaaagagcttgaaaaagtaaaacgtgttatcgaaagagaagttcctgaagctccgcatgaggtgctgcttgcccttgatgccacgaccggccaaaatgcaatggctcaggcaaaagaattctctaaagcaacaaatgttaccggcattgctttaacgaagcttgacggtacggcaaaaggcggtatcgtccttgcgattcgcaacgagcttcacatcccggttaaactagtcggtttaggagaaaaagttgatgaccttcaggaatttgatccagaatcctatgtgtacggactcttttcagatttagtggaaaaagccgacgattaagaaaaaggccccaacatcttggggcctttttcttttttatcttcttacttgataggcgaaatgataaaggctgttatcagtggataccagtcttgactcaccagaaaaaactctgaatgggatgatgtcatagtaatgaacggaaacagatgtgtaatacgtatagtaaccagcagctggccccaaatacattggaacctcaaatgttccgtttgcatcagttgttcctgaagcagtttgtgttgtgtttccgaccttcgtgtccgcttcaaatcttacgggcgcgtttggcactggctgtccgttttggtcgagtaatttgccgcttactgtaatattgtacttgactcgccaatattgaccttgcccgtaattgattttaccgtatacccctccatctgtgctgatatttgtgattgaggccttataaggtgcctcagcagcgtctgcttgctgtgccgggaaacctattgtaaacagggctgccagacacaacataaacaataaaccgatttttttcataaaaatcctccttaaaatagggttcatatacaatatcggaataaattggatgatatttagcgtattttggaaaaggttaatcgtcgctttgacaagataaaaacttgacagtgtcaataaaaccgtgtaaactaagttatcgtaaagggatttgacttaacaaaggggagagctcaaatgtcactcgaaaagacaacgagaatgaattatctgtttgatttttatcagtcgttgttgacgtcaaaacagaagagctatatgtcgctttattatttggacgatttctccctaggcgaaatagccgaagaatatgaggtttcaagacaagctgtttatgataacatcaaacgaacagaagcgatgcttgaacaatatgaagaaaagctgctccttttgaaaaagtttcaggagcgtaaagagatgtttaataagctgaaggagcttgcttccggttcaaaagaagaggaagaaattacagctctgattgaagcgcttgagaaattagattaggaggcggcaaactatggcatttgaaggattagccgaccgactgcagcagacgatttctaaaatccgcggaaaagggaaagtcagcgaacaagatgtaaaagatatgatgcgtgaggttcgtcttgcgctgcttgaggctgacgttaactttaaagtagtcaaagattttgtcaaaaaagtaagtgaacgcgctgtaggccaagacgtcatgaaaagtctgacgcccggccagcaggtcattaaagttgttcaagaggaactgactgagctgatgggcggcgaagagagcaaaatcgccgtcgcaaaaaggccgccgactgttattatgatggtcggtctccaaggtgccggtaaaacgacaacaagcggtaagcttgcgaatctgctgcgcaaaaagcataatcgcaaaccgatgctggttgctgccgatatttaccgcccagccgcaattaagcagctggaaacactcggcaaacagcttgatatgcctgttttttctcttggcgatcaggtcagtcctgtagaaatagctaaacaggctattgagaaagccaaggaagaacattatgactatgtcattttggatacggcaggccgcttgcatatcgaccatgaactgatggatgaactgaccaacgtcaaagaaatcgcgaatccggaagaaattttcctggttgtcgattcaatgaccggtcaggacgctgtgaatgttgccaaaagctttaatgaacagctcggtttaaccggtgttgtgttaactaagctggatggagacacacgcggcggggctgcgctttctattcgcgctgtcacaaacacgccaattaagttcgcaggtttgggcgaaaagcttgatgcgttagagccgttccaccctgaacgcatggcatcaaggattctcggcatgggcgacgtgctgacattgattgaaaaagcacaggccagcgttgatgaagacaaagccaaagagctggaacaaaaaatgagaacgatgagcttcacattggacgattttctggagcagctcgggcaagtcagaaacatggggccgcttgatgagcttctgcaaatgatgccgggtgcaggtaaaatgaaaggcctgaaaaacatccaagttgatgaaaaacagctgaatcatgtggaagcaatcattaaatcaatgactgttcttgaaaaagaacagccggatatcatcaatgccagccggcggaagcggattgcgaaaggaagcgggacatccgtacaggaagtcaaccgtctgcttaagcagtttgatgaaatgaaaaaaatgatgaagcagatgacaaacatgtcaaaaggcaagaaaaaagggtttaagctaccttttatgtaatcggttatacatgataaaaccgttgttaagaaaaaacactttacaaacacttttatcattgttaatatactatcttgttgaaatattttcggaggtgctagtaaaatggcagtaaaaattcgtttaaaacgtatgggagcaaaaaaatctcctttctatcgtattgttgtagcagattctcgttcaccacgtgacggccgtttcatcgaaacagtcggaacttacaacccggttgcaaaaccagcggaagtaaaaattgacgaagagcttgctcttaaatggcttcaaactggagcgaaaccatctgatacagttcgcaacttgttctctagccaaggaatcatggaaaaattccacaacgctaaacaaggcaagtaatgactgatcaacacttggaagatttgattgtccacattgtgacgccgcttgttgatcatccagatgacattcgcgtcataagagaagaaaccgatcaaaagattgcgctgcgcttatctgtccataagtcagataccggtaaagttatcggaaagcaaggccggactgcaaaagcgattcgaacagctgtatttgcagctggcgcacagtcttctaagaaagttcaatttgaaatatttgactaaaagggagagggccggcacctcccctttttttacacgcaaaaaaagggtaaactgatagaagcttaggcaaaatagaaaagcctgggcgagtaaaagttttaaaagcggggagcttggtgcgatgcaaattattcaccgtgtagccgttatgcaagtcttaaccgagcgcagtaaagaaaagcttttagcttcttttgccgaaaagaaacaaatgcttgaacgagaatgcagccagctctattttcagcttagaaaacatgagaaagaacagcaaaaccctgatatgatagaacaatttaaaaaggcaatagaaaagcgaaaagatgatatgaaaatcatcgattttcaaattgctcaagtacatacattgcagcttggcagtgagttgaaagaaaaggaagtcgatgcgctgctgacgattgaagccggggatgactggcatgagaaaacagcagcgaacaccatcgtcataaaagacggaaaagtaattgaaattcgccagaggtgatcatatgacaaagcgatggtttaatgtaggcaaaatcgtaaatacccacggaatcaaaggcgaagtgcgggtgatttcaaaaacagattttgccgaagaacgatacaagccgggaaacacgctgtatttgtttatggacggccgtaacgaaccagtggaggtaacggtaaacacacatagactgcataagcaatttcatctcctgcagtttaaagaaagacaaaacctaaatgaagtagaagagctgaaaaacgcaatcattaaagttcctgaagaagaattaggagagctgaatgagggtgaattttatttccacgaaattattgggtgtgaagtatttactgaagaaggcgaactcatcggaaaggtcaaagaaattttgacgcctggagccaatgacgtttgggtcatcggacgaaaaggaaaaaaagacgcactcattccttacattgaatcagtggtcaaacatatcgatgtcagggaaaagaaaattgagattgaactcatggaagggttaatagacgaatgaaaatcgactttttgacgctgtttcccgaaatgtttgaaggcgtgctcggctcatcgattcttcaaaaagcccaggaaaaagatgcggtgcagtttcaagtcgtaaatttccgggagtactctgataacaagcacaatactgttgatgattatccttatggcggcggggcaggcatggttctcaagccccagcctgtttttgacgcggtcgaggacctgacatcaaaggcagccgctgctccgcgtattatcctcgtatgcccgcaaggtgagcgttttacccaaaaaaaagccgagcaattagcaaaggaagagcatttgctgttcatttgcggccattatgaaggctatgatgaacgcattcgcgagcacttggtaacggatgaaatatcaattggcgactttgttctgacgggcggtgagctccctgcaatgatgatcgcagacagtgtggtcagactgcttccgggtgtactgggtaaagaggcttcccatattgaggattccttcagcaccggacttttagagcacccgcattatacaagaccggcagattacaaaggtttaaaagtgcctgaaacactcttgtcaggaaaccatgcaaaaattgaagaatggcggaataaagaatcgatcagaaggacctacctaagacgtccggatctgttgaaagactacccgcttacagagcagcaaagaaagtggatttctgaatgggaaaaagaatagattttattgcataggctatgaaattgtgataagatactacttgtggcttaagcgggcttatccgctgcaagcttgaaaacgatgttccgctgtgccggtttttgtggccaagagcatctgttggaaggagttgaaaacgatgcaaaaactaattgaagatatcacaaaagaacagcttcgtactgatcttcctgcgttccgtcctggtgacactttacgtgtacacgttaaagttgttgagggtaaccgtgagcgtatccagatctttgaaggtgttgtgattaagcgtcgtggtggtggaatcagcgaaacgttcacagttcgtaagatttcttacggtgttggcgttgaacgtactttcccagtacacacaccaaaaatcgcgaaaatcgaagttgtacgttacggtaaagtacgccgtgctaaactttactacctgcgtgaacttcgcggaaaagcggctcgtattaaagagatcagacgataatgataacgaacgaaaagagcttgttacctgtaacaagctctttttttatacagaatttgaaaatgccggacaggcatcgtaaaatacataaaggacaacaatgaatcatgcatactgaagataaaggcggtgttcgtgtcacatgacaattcaatggttcccgggccatatggcaaaagcaagaagggaagtaaccgaaaaattaaaattaatcgatatcgtatatgaattggtagatgccagaattccaatgtcatcaagaaacccaatgattgaagatattctaaaaaacaagccgcgaattatgctgttaaacaaggctgacaaagcagatgcggcagttacacagcagtggaaagagcactttgagaagcaggggatccgctctctgtctattaattctgtaaatggacaagggttaaatcaaattgtgcctgcatcaaaagagatcctccaagaaaaatttgaccggatgcgtgcgaaaggtgtgaagccgagagcgattcgcgctttgattatcggcattccaaacgtcggaaaatcaacactcatcaaccggcttgcaaagaaaaacatagcaaaaacgggagacagacctggtattacaacctctcaacagtgggtcaaagttgggaaagaattagagctattagatacaccgggaattttgtggcctaaatttgaggatgagcttgtcggtttgagactggcagtcaccggggctattaaagactcgattatcaatttgcaggacgtggccgtgtttggtcttcgttttctcgaagaacattacccagaacggctcaaggagcgttatggccttgaggagatcccagaggacattgccgagctgtttgatgcaataggtgaaaagcggggctgtctcatgagcggcgggctcattaactacgataagacgactgaagtcatcattcgcgatattcgcactgaaaagttcggcaggctgtcatttgaacagccgacgatgtaaaggcgcgcagaaatgcgggtctttattttttcttggctgaaccgatacatacagtaagggagaagagaaagtgaatacattaaccgtaaaggacattaaagaccgtttgcaggaagtgaaggatgcacaagacccatttatttcccaatgcgaaaacgacccgagaaaaagcgttcaaacgcttgtagagcaatggcttaaaaagcaagcgaaagaaaaagcgctgaaagaacaatgggtgaatatgacttcctatgaaaggctggcaagaaacaaaggatttcgcttgattgcaggtgttgacgaggtcggccgggggccattggcaggaccagttgtcgccagcgcagtcatccttccagaggaatgtgaaatacttgggctgacagactccaaaaagctttcagagaaaaaacgcgaggaatattacgagcttattatgaaggaagcactggcggtcgggataggaattgtagaagctactgtgattgatgagatcaatatatatgaagcttcaaaaatggcaatggtgagagcgatacaggatttgtcggatacacctgattatttgcttgttgacgcaatgacacttccgctcgacacggctcaggcgtcaattataaaaggcgatgccaaaagcgtgtctattgcggcaggtgcgtgtatcgcaaaagtgacgagggaccgaatgatgagcgcttatgccgaaacgtatcccatgtacggctttgaaaaaaataaaggctatgggacaaaagaacatttggaagctctcgctgcatacggcccaactgaattgcaccgcaaaactttcgctcctgttcaatctttcagataaatcaccatggacaaggaggcacctttttaaaatgaacatacgaaatgatgtgcaaaaggcgctgcagcaccttttcgggcgtacagccgtcccgcaggaaacatcaaaagtaaacgaagcgctaaacggggagaagcgtctcctcttaggaaaagtgcttcgtttactaggagatcagcatgccctgatccaagtcggcaatcaaactgttcagggaaaacttgaaactcagcttcgtcctcaggcatactattggttttcctacgaaaaaaaaacggcagagcaaacaggccgtcttcaggtcgttcaaagctttgatcaaaatcctaaaaccattcaggatgcagctggcaaacttttaaatgctatttcagtgaagacgtcaaacgcagctctcatgatgacaggagcgatgctgaaaagcaaaacacccgtaacagaaaatgatatcaaaacagctgtccgctggatggacacgctgccttcgcaagacacaaaaaaagcagttgaaacggttctcttcgctttaaagcgtgatcttcccattcactccgagattttgaatggtgttcacgctgtgaaatcgcctgttccgttgcatcagcacgtatcccagctgctacaggcaatcgaccaaaaccctcagcagagccaaatgatgtcaaagctaaaggaagcagttacggtgcttttaaatagtgaaatcgatgtccatgcagaacggctgattgataagcttatttctttaaccgacaatacgaaagcaccttctccgacgaatacagctggaagcagggagcttagcacaccagctggctcccccggaaaagccagcctgccgattgcaaatcacacagcagaacagggaagcatacaagaagagcctgttaaaacagcagcagacattccaattaaagaagcccgccagctgctcgtgaagctgacggaatctgctgaaaaaaacagtctccaaattgtgaaagaagcagcaaattggattaaagcggctgcttcatcgggtgatagtaagtcacttgcagcttcagctgttttacaagcggcacaagtcacagaccaggaagccgaagtctttttaaaggctgttcagcagacagcaccccatttggcggataaggcagatgttctttctttcttatccaaagtgaaaacggcaatcggcgcaagggacgaggttgcgttcattaaagcgtttgaacaaggaagcgcagtcacatctggcgaaatgcaatccatcaagctggctctttctgccttaagagcatcgcatgaggtagccgaaccagtcaaacaagaagccgatcagctttttcataaattaaatggccagcttttcatgcagcaggaccatccatcatacagccaaattgtaatgtcatttccgatgttttcgaagtcaggggttcaggacatgactgttctgtttaaaggaaagaaagaagcggatggaaagcttgatccttcccattgccgccttttgtttttgctgcagcttgatacactaaaagaaaccgtcgttgattgcttggtacagcaaaaagtcatgaccattacaatagagactgatttcgagctgcaggctgcgatcgatccgatggtgcccgcgcttaaacaggggctaaaggaaatggggtacagcctttcaggggtaaacgctaaaaaaagggttcacaccgaagaaaaggcttcaatcgatcaatatataacaagtatcagtgatcaggaagtggatgtgaaaatatgaaagagcagacaccgatcagaaaagctgttgctctccattatgacgaacaaaaagacaaggcgccgagagtgattgccacagggaagggccatgtagctgacaacattatcaaagaagcgaaaaaagcaggggtcccgattcaagaagatcggacccttgtcgaattaatgcgccatttgacggtagatgatcaaattcctgaagctctttatgaaacggtagccgagattttttcattcatttacaaattggacgaaagcgtaaaaaacgaaaaatagctaaaatattccccatcctcctttgaaatttatgtttttaataaagtaaaagtttgaatgtttagaaggattaaaagattttgcatcgaactgtagacaattcttccagtattattatagaatgaaagcgcagtctattttagttttgttacataagttaggaggatgggaaatgaatatccatgagtaccagggaaaagaagtcctcagaaaatatggggtatctgttcctgaaggtaaagtggcttttacagcagaagaagcagttgagagtgcaaagagcttatccagctcggtttatgtcgtaaaggctcaaattcatgctggcggtcgaggcaaagctggtggggtaaaaatagcaaaatcattagacgaagtaaaagcgtatgccgaagaactattagggaagaccctagttacacatcagacgggtccggacggccaagtaataaaacgcttacttattgaagaaggctgcgatattaaaaaagaatattacatcggtctagtgcttgaccgcgccacttcaagaatcgttttgatggcttctgaagaaggcggaacggaaattgaagaggttgcggagaaaacaccggaaaaaatcaaaaaagctgtcattgatccggctgttggccttcaaggctatcaagccagagaaattgcattcgctattaatattccaaaagagctcgtgggaaaagctgctaaatttatgcttggactatataaagcgtttgttgagaaagactgctcaatcgccgaaatcaatccgcttgttgttaccggcgacggaaatgtgatggcgcttgatgcaaaattgaattttgacagcaatgcgttgtaccgacaaaaggacattatggaatacagagatttggatgaagaagatccgaaagaaattgaagcgtccaaatatgatctaagctacatttcccttgatggaaatatcggctgtatggtaaacggcgcggggcttgcaatgtccacgatggatattatcaagcattatggaggagaaccggccaacttccttgatgtgggcggcggtgcaaccgctgaaaaagtcacggaagcatttaaaatcattctttctgatcaaaacgttaaagggatttttgtcaacattttcggcggcattatgaaatgtgatgtcatcgcagaaggggttgttgaagcgactagacaagttggtttgacattgccgcttgtcgtccgtcttgaaggcacaaacgtggatctagggaagaaaatccttagtgaatcaggattaaacattacatctgcggaatcaatggctgacggcgcgcagaaaatcgtatccttagtttaagaaagaatgaaaggcaggggaccaaataatgagtgttttcattaataaagatacaagagttattgtgcaagggattacaggttctaccgctttatttcatacgaagcagatgcttgaatacggcacaaatatcgttggcggtgtaacacctggaaaaggcggaacagaagcggaaggtgttcctgtatttaatacagtggctgaagcagttcaaacaaccggcgctaacgcgtctgttatatatgtgcccgcaccgtttgcagctgatgcgattatggaagcggtagatgcggagcttgatctcgtgatttgtatcacagaacatatcccggttttggatatggtgaaggtcaaacgcttcatggaaggcaagaaaacgagactgatagggccgaactgtcctggtgtcattacgcctgaagaatgtaaaatcggcattatgcccggatacatccataaaaagggtcatgtaggcgttgtatcacgttcaggaacattaacatacgaagcggtgcaccagctctcagaagcgggtgtagggcaatctacagctgtgggaatcggcggcgaccctgtaaatggaacaaactttattgacgttttaaaagcgtttaacgaagatcctgacactcacgcagtcatcatgattggcgaaatcggcggtactgccgaagaggaagcggcagagtgggtaaaagccaacatgacaaaaccggtagtcggttttatcggcggtaaaacagcacctcctgggaagcgcatggggcatgcaggcgccattatttccggcggaaaagggacagctgatgaaaaaatcaaaacccttaatgcatgcggaatcgaagttgcagagacaccttctgtcatgggtgaaaccttaatcaaggtgctgaaagagaagaacttgttcgaaacttgcaaaacgcattaataaaaaagggacagccgtcaaggctgttcctgctttttctaacaaaaggaggtcaatctattggatcaggccgctgcctgcctaacgatttgcagaatcaatcaattattatccccatcccttctattaaaatggtggaaagccgatccgtctatgtcgctgacatcacccgtgttacaaacggttactcgtgatcaaataaaagcagctgcattaaaaaacgaaatagaacaattttatccaaagctcccgcgtgtacttgctgcttatcgtgagcaaggcattaacaccatccctatttcttcaaagcaatatcctttctggcttaaaagcatttatgatccccctgccgtactgtttgcaaaaggtgatatgactcttctttcgaaagggagaaaaattggaattgtagggacaagaaatccaacagcttatgggaaacaagttgtcaatcatcttacaaaagagatctgtcgtaaaggttgggtgattgtcagcggactggcgtctgggatagacggaatgtcccatgctgcaagtattaaggcgaaggggcggacaattggcgtcattgcaggcggatttcaacacatttatccccgagaaaaccttcagttagcagatcacatggctaaacaccatatcctgctgtcagagcacccacctgaaactaaaccccaaaaatggcatttccctatgagaaaccgtattatcagcggactaagtgaaggcgttattgtcgttcagggcaaagaaaaaagcggttcgctgattactgcctatcaagcattggaacaagggagagaggtatttgccgtacccggttcattgtttgacccttacgccggaggtcctataaaactgatccagcagggggctaaagccatatggtcagcagaggatattttcgaggaacttcctgagagaaacgttcaatatacggaacccttttgaattatcgtttgacaaacggtattgtaatatttaataatagtgaggatttaaagttgcatattgttttctatttaattaatgacgttcatgataaagaatgaaatgttgaaagccaaataaagacagctgcaaaaataaaattgaaatatcttgaaaagagagagaacacctcttgagggggatgaaaatgtctgattatctagtcatcgtggaatcgcccgctaaggcgaaaacgattgaacgttacttaggtaaaaaatataaagtaaaagcatcaatgggacatgtccgggatcttccaaaaagtcaaatgggagttgacatagaacagaattttgaaccgaaatatattaccattcgaggtaaaggcccggtattaaaagagctgaaaacggctgcgaaaaaagccaaaaaagtgtatctcgcagccgaccccgacagagaaggggaagcgattgcatggcatttggcacacagtcttgatttagatctcaactcagactgccgtgtggtgtttaacgaaattacaaaagacgctattaaggaatcgtttaagcatccccgcatgatcaatatggatttagtggatgcacagcaagcgagacgtattttagacaggcttgtcggatataaaatcagtccaatcttatggaaaaaagtcaaaaaagggcttagcgcaggacgcgtgcaatccgttgccctccgtttgattattgaccgtgaaaaagagattaacgactttaagcctgaggaatattggacaattgacggtacgttcttaaaaggtcaagaaacctttgaagcgagctttttcgggaaaaacggcaaaaaacttcctttaaatagtgaagctgatgtaaaagagattctttctcagctcaaagggaatcaatatacagttgaaaaagtaaccaaaaaggaacgcaaacgtaatcctgctttgccttttaccacttctaccctgcagcaggaagcggctcgcaagctcaatttcagagcgaagaaaacgatgatgattgcacagcaattatatgaaggaattgatttaggaagagaaggaacggttggtctgatcacgtatatgagaacggattcaacccgtatttcaaatacggctgttgatgaagcagctgcatttattgatcagacatatggaaaagagttcctaggcggaaaacggaagcctgcgaaaaagaatgaaaatgcccaggatgcccacgaagcaattcggccgacatcagttcttagaaaaccaagtgaattaaaagcagtcctcggcagagaccaaatgagactgtataaattaatttgggagcgttttgttgccagccaaatggcaccggctgttctcgatacaatgagtgtcgacctgacaaacaacggtttgacatttcgtgcaaatggaagtaaagtcaagttttccgggtttatgaaggtgtatgttgaaggaaaagacgatcaaatggaagaaaaagaccggatgctgcctgacttacaagaaggcgacacggtattatcaaaagatatagaacctgagcagcattttacccagccgcctccgcgatatactgaggcccggcttgttaaaacccttgaagaacgcggtatcggccgtccatccacatatgctccgacacttgatactattcagcggcgcggctacgtggcattggataataaacgtttcgttccgactgaattaggtcagatcgttcttgacttgatcatggagtttttccctgagatcattaacgttgagtttacagctaaaatggagagagatcttgatcatgttgaagaaggaaataccgaatgggtcaagattatcgataatttctacaccgattttgaaaaacgcgtcaaaaaagccgaatcggaaatgaaggaagttgagattgaaccagagtatgctggagaggattgtgaattgtgcagttctccaatggtatataaaatgggacggtacggtaaattcttagcttgctccaacttccctgactgccggaacacgaaaccgattgtgaaacaaatcggtgtgaagtgcccgagctgcggagaaggaaacattgttgagcgaaaatcgaaaaagaaacgggtgttttacggctgtgaccgttatccggactgtgaattcgtatcatgggacaaaccaattgaacgaaaatgcccgaaatgcggaaaaatgctcgtcgagaaaaaactcaaaaaaggtatacaagtccaatgcgtggaatgcgattataaggaagaaccacagaagtagcggtgagcagggtcttgctcaccttctttgtgtgttaaaagaaggccttgaataataaaataggagatgtgaaagatgaaccaacaaacagtgaatgtaatcggagccggactcgcaggaagtgaagcagcatggcagcttgccaaacgtgggattcaagtcaaattgtatgaaatgcggccagttaaacaaacgcctgcgcaccatacagataaatttgctgagcttgtctgcagcaactctcttcgctctaatacacttgctaacgctgtcggtgtattaaaggaagaaatgcgtgcgcttgattcagccattatcgctgcggctgacgaatgttcggtgcctgccgggggcgctcttgcagtagaccgtcatgaatttgccgcaagtgtgacaaatcgggtgaaaaatcatccaaacgtaaccgttattaatgaagaagtgactgaaattcctgaaggccctactatcatcgcaacgggtccgttaacatctgaatcgctgtctgcccagctgaaggagctgactggagaggactatttatatttttatgacgcagcggcgccaattgtagaaaaagacagccttgatatggataaagtgtacctaaaatcccgttatgataaaggtgaagcagcatatttgaactgcccgatgacagaagaagagtttgaccgttttcatgaagcattaacatcagcagaaacagtgccgttaaaagaatttgaaaaagagattttctttgaaggctgcatgccgattgaagttatggcaaaacggggtaagaaaacaatgcttttcggtccgatgaaaccggttggtctagagcatcctgttacaggaaaacgcccttatgccgtcgttcagctcagacaggatgatgctgcgggaacactttataatattgtaggattccagactcatttaaaatggggagaccaaaaggaagttctcaagttgattccaggacttgaaaatgtagaaatcgtcagatatggcgtgatgcacagaaacacatttattaactctccaagcctgttaaagccgacttatcaatttaaaaaccgcagtgatctgttctttgcaggccaaatgacgggagtagaaggatatgtggaatcagctgcctcaggacttgtagcaggcattaatgcggcgaagcttgtattgggagaagagcttgtgatcttccctcaggaaacagcaattggcagtatggcacattatattacaacaacaaaccagaagaacttccagccgatgaatgcaaactttgggcttttgaaagaattgccagttaaaattaaaaataaaaaagaacgaaatgaacaatacgcgaaccgtgcgattgaaacaattcaaacaatttcgaaaacaatataggtattgattgcaacctgagcgcgatttgtgataccatttaaaagcccttcctggggaggtattaggcatggagaatgttaagaatttcgtaaagttattcgttgaatatttacaaattgaaaaaaattattcacaatatactattgtgaattatgtggattcaattgaagaattcgagactttcctgcgcgttcaaggtataaatggatttgaagaagctgcatatcaagatactaggatttttttgacagaagcctatgaaaaaggtttatcgagaagaacaataagcaaaaagatatctgcattaagaagcttttataagtttctgatgcgggaaaagcttattgaagaaaatccgtttcagcttgttcatctgccaaaacaggagaaacggataccgaagtttctatatcaaaaagagcttgaggagctgtttgaagtttcagatataagccagccggccggaatgagggatcaagcgctgttagagctgctctatgccaccggaatgagggtcagtgaatgctgttccataactattaacgacgttgatttatttatggacactgtgcttgttcacggtaaaggcaagaagcagcgctatatcccctttgggtcttatgcccgcgaagcgttgaaggtatacatgaatagcggaagacagtgcttgctgatgaaggcaaaagaacctcatgatctattattcgtaaatcaaagaggcggaccgcttacagcccgtggcatcagacatattttaagcgggcttgttcaaaaagcgtcaagcactttacatatccatccgcatatgcttcgacatacgttcgccacgcatctgttaaatgaaggagcggatttgagaagcgttcaagaactgctcgggcattccaatctgtcttctacacagatatacacgcacgtttcgaaggaaatgttgagaaacacatatatgtctcaccatccaagagcatttaagaaaaattaaaggaggccctttatgtcatcttttcatgcgaccacaatatttgccgtacagcataaaggacgaagcgctatgtccggagacggccaagtaacatttggtcaggctgttgtcatgaaacacacggcacggaaagtgagaaaactgtttaacggcaaagttcttgctggctttgcgggatctgttgcagacgctttcactttattcgaaaagtttgaagctaagcttgaagaatataacggcaacttaaaacgggcggctgttgagcttgcgaaggaatggcgcagtgataaagtgctaagaaagctcgaagccatgctgattgttatgaatcaggatactttgcttctcatatcgggaacaggcgaggtgatcgaaccagatgacggcattctcgcgattggatcaggaggcaattacgctttggcagcgggaagagcactgaaaaagcatgccggtgaaagcatgtctgcaagtgagattgccagagccgcgttagaaacagcaggcgaaatttgtgtttacacgaacgatcaaatcatactggaagagcttgaatagaaaggacttgaggcgcatggaaaaaaaaccgttaactcctagacagattgtagatcggttagaccaatatattgtcggtcagcaaaatgcgaaaaaagctgtcgccgtggcattaagaaaccgctatagaagaagtcttctggatgaaaagctgaaggacgaggtcgttccgaaaaacattttaatgatgggtcctaccggcgtcgggaaaactgaaattgccagacgaatcgctaagctttcaggtgcgccatttatcaaaattgaagcgactaaatttaccgaagtcggctatgtaggcagagatgttgaatcaatggtcagagatcttgtggagacttctgttcggcttataaaagaagagaaaatgaatgaagtaaaggaacaggcagaagaaaatgcaaacaaacgcattgttcgtctgttagttcctgggaagaaaaaacaatctggcgttaaaaatccgtttgaaatgttttttggaggcagccagccgaatggtgaagatgaggcggagagccaggaagaagcaaacatcgaagaaaaaagaaaacgaatggcacatcagctggctttaggagagctcgaagactactatgtaacagtagaagtcgaagagcagcagccttctatgtttgacatgctgcagggctcgggtatggagcagatgggtatgaacatgcaggatgcgctgagcggattaatgccaaagaaaaagaaacggcgcaaaatgacagtcagagaagccagaaaagttctgacgaatgaagaagcaagcaaactcatcgatatggatgaagtcggccaggaagcagttcagagagcagaagagagcgggattatctttatcgatgagattgataaaatcgcaaagaacggcggtgcatcttcttctgccgatgtttcaagagaaggcgttcagcgggatatccttccgattgttgaaggttctaccgttgtcacaaaatatggttctgtaaaaacagaccatgtattatttattgcagcaggagcgtttcatatggccaaaccgtctgatttgattcctgagctgcaggggcgtttcccaattcgtgtagaactgaacaaactcacggtagacgacttcgtgagaattttggttgagccggataatgcgctgctgaaacaatatcaggcattattgcagacagaaggtatatctcttgaattttctgacgaagctattcataagattgctgaagttgcttatcatgtgaaccaggacacagataatatcggtgcgagacgccttcatacaatacttgaacgcctattagaagatttgtcgtttgaagctccagatgtaacgatggagaaaataacgattacaccacagtatgtcgaagaaaagctcggaacgatagccaaaaacaaagatttaagtcaatttatattgtgaaaaatttaatatgaggaatgtttaggaggattatttatcatggctttattacaaaaaacaagaattattaactccatgctgcaagctgcggcagggaaaccggtaaacttcaaggaaatggcggagacgctgcgggatgtaattgattccaatattttcgttgtaagccgcagagggaaactccttgggtattctattaaccagcaaattgaaaatgatcgtatgaaaaaaatgcttgaggatcgtcaattccctgaagagtatacgaaaaatctgtttaatgtccctgaaacatcttctaacttggatattaatagtgaatatactgctttccctgttgagaacagagacctgttccaagctggtttaacaacaattgtgccgatcatcggaggcggggaaagattaggaacacttattctttcacgtttacaagatcaattcaatgacgatgacttaattctagcagaatacggcgcaacagttgtcggaatggaaatcctaagagaaaaagcagaagaaattgaagaggaagcaagaagcaaagctgtcgtacaaatggctatcagctcgctttcttacagtgagcttgaagcaattgagcacatttttgaggagcttgacggaaacgaaggtcttcttgttgcaagtaaaattgctgaccgtgtcggcattacccgttctgttattgtgaacgcactcagaaagctggagagcgccggtgttatcgagtctagatcattaggaatgaaaggtacttatatcaaggtactaaacaacaaattcctaattgaattagaaaatctaaaatctcattaatcacaaaaagaaccctttttgagggttctttttttatttcaaataaaggaaatcaataagctttatttcctgggttgaaagtctttctatgtaataattttaataaattttgcatttttcttcaaaaagtttcaaaaatgccgaaaagaaaggagaaaaaacagaaattctgctattttcaggcttatatcaaggcgagaaatgtagttctaacaatctaggactttatacctagttgcaaaatagataattgtgaggacatttttttacacgaacttcatagactttatgcctgttatttcttacaataagcatatagttttacaattctcgacaaggatattgagggtgaaaaaaactgaaatggaggtaagtggatttgagcttattttctggaacgatacaaaatcttgaaaatgccttgagtagagcggatattaagcaaaaagtcataactaataatatcgccaatatagatacaccgaactataaggcaaaaaaagtctctttccaaaatttattagatcaagaatcctcgcgtcttgaagcgataaaaacagactatcgtcatgttgatttttctgatactgattcgaattattcaattgttgcgagcggagatacatcgtatcagcaaaacggaaacaatgttgatgttgacaaagagatgacagaattggcgcaaaatcaaatcaactatcaagctttggttgaaagaatgaacggtaaatttaattcgctgaagaccgtattaacaggaggaaaatgatgacagcttttcatagcttaaatgtttcagcatcggctttaacagctcagcgagtcagaatggacgttgtatcatctaacttagcaaatatggatacgacaagagctaagcaggtgaatggagagtgggtgccttacagaagaaaaatggtttcccttcagtcaaaaggtgaatcgttctcttctattctcaattctcaaatgagcggaagcgggaatgctggaaacggtgtgaaggtttcaaaaattacggaggatgattcagattttaatcttgtctatgatccgacagaccctgatgcaaacgctgaaggatatgtacaaaagcctaatgttgatccattaaaggaaatggttgatcttgtcagcagcaccagatcatacgaggcgaatgtcacggcgatgaatgccacaaagggaatgctgatgaaggcgttagaaatcggaaagtaggtgaatgaatgtgattaatgcaatttctccttttcaggttcaaaatactcaaaacactcaaaatgcaacaaatcaagtaaacaatagccaaaaaacagattcttcaaatcaaacaagcttttcggagcttttaaaaaactctattagttcgttaaatgagtcccaagtagcttctgacaacatgactaatgccttggctgcaggaaaagatgtaaatcttgatgaggtcatgatcgctgctcaaaaagccagcatctctctaactgcagcaacagagttccgcaataaagctgtggaagcttatcaggagattatgagaatgcaaatgtagggggtctgacgatttagagaaagagtggaatgaccgggggttaacatgaatcgtactctaatgcaaatgaaaaacaaaacgagtgagttttggaaaaatagatctaaattacaaaagattttaatggttagtgctttagcggcaattattattattggaattattattagtgtttttgcttcgaattctaaaatggcgccgctgtacaaagatttgtctgccgaagaagcaggacaaatcaaagaagaattggatgcaaaaaaagtgccaaacgaactttcgaatggcggtacagtgattagtgttccggaggatcaggttgattctttgaaagtgcagatggctgcagaaggacttcctaaaacgggatcaattgattattcgttttttggacagaatgccggctttggtttgacagacaatgagtttgatatggtgaaagtgaaagctacacagacagaactgtcaaacttgatcaatgaaatggacggtattaaaaattcaaaagtaatgattaatctcccgaaagacgctgtgtttgtcggtgaggagcaatctgcagcatctgcatcaatcgttttgcagattcaaccgggttatacacttgatcaaagccaaatcaacggattatatcatctggtatctaaaagcgtgccaaacctaaaagaagataacatcgtcatcatggaccaaaattctacatactacgacaaatcagacagcgatgcagggtcctacgcggatagttattcttctcagcaaggaattaagtctcaagttgaaaaagacattcaaaaacatgtacagtcattgctgggtacgatgatgggccaagataaagtcgttgtctccgttacagcagacattgatttcacaaaagaaaatcggacagaagacattgtcgaacctgtggataaagaaaacatggaaggcattgcagtcagcgctgaaaaggtatctgaaacatatcagggcgacggtgcagccaacggcggaactgccggaaccggcgaggaagatgtaccaaattataaggctgacggtgaaaataccgaaagcgggaactatgaaaaaaacagcaacaaaatcaattacgaggttaaccgaattcataaagaaatcgctgaaagtccttataaggtcagagatttagggattcaagtaatggtagagccgcctgatgccaaaaacacagcgtcgctatcaactgaaagacaggatgatatacaaaaaatcctttcaactgtagtcagaacatctttggataaagatgaaacgcaaaatcagaatttatctgatgctgatatcaataataagattgttgtttccgttcagccattcgacggaaaagtcaatttggatacaaatacggaaaaatcctctggtatcccgctgtgggcatatattgtaggcggtgttttaatcgcagcgattattgttctgatcattatgcttatcagaaagaaacgggcgcaagaggatgaatttgaggaatatgagtatgaggttcctcaagaacctatcaatttgcctgatatcaacgaagaggaaaatgaaacagcggaatcagtcagacgaaaacagcttgaaaagatggcgaaagacaagccggaagattttgcaaaactgctgagaagctggctggccgaggattaggaggaattagaaatggcgagacgtgatcaagataagcttacaggaaaacaaaaagcagccattctcatgatttccttggggttagatgtgtcagcttctgtctataagcacttaaccgatgaagaaattgaaaggcttactctggaaatatcaggtgttcgaagcgtcgatcatcaaaaaaaggatgaaatcatagaagaatttcataatatagccattgcacaagattatatttctcaaggcggtttaagctatgcaagacaagttctggaaaaggcgcttggagaggataaggcagagaacattctaaacaggctgacttcttctttgcaggttaaaccatttgattttgccagaaaagcggagcctgaacaaattttgaattttatccagcaagagcatccgcagacgatggcgttaatcttgtcttatttagatccagtgcaggccgggcagattttatccgagctgaatccggaagtacaggctgaggttgcgagaagaatcgcggttatggatagaacatctccagaaataattaatgaggtagaacggattctggaacaaaaattatcttctgcatttactcaggattatacacaaacaggcggaattgaagctgttgtggaagtgttaaacggggtagacagagggacagagaagacgatcttggattcattggaaattcaggatcccgatcttgctgaagaaattaaaaagcggatgtttgtcttcgaagatattgtcacacttgataaccgtgccattcagagagtcattcgcgatgttgagaacgacgatttgctcctttcattaaaggttgcaagcgaggaagtcaaagaaattgtattcaacaatatgtcacagcgtatggttgaaaccttcaaagaagaaatggaatttatgggccctgtacgcttgaaagatgtagaagaagctcaatcgagaattgtaagtatcgtcagaaagcttgaagaagccggtgaaattgtaatagcaagaggcggaggggatgatattattgtctaatatcattaaacaagaatcatctatttctccacaaaaggaaaaaagaaaactttctatacaagaggtgcgtattgatcattctcaccttttgcaggctgaagagaacccggaggcgcttatggcccgagtgaaagaggaagctgatcggatttctgagcaggcaaacagtcatatagaaaatattcgccgtcaaattgaacaggagaaaaacgattgggcggctgaaaaacagaagcttattgaagaagcaaaagccgagggctttgaacaaggagtagcgctgggcaaagctgaggcaatgaaacagtatgcagaactgatcggccaagcaaacagtataactgaaatgtccagaaaagctgttgaggacaagcttgaagacgctaatgaagaaatcgttgagcttgccgttgccctagcaaaaaaagtttggcagcaaaagtctgatgataaagaggctttcctcctgcttgtacaacaggttataaacgaagtgaaggaatatgacgatatatcaatttatgttgatccatattactatgagacaatctttcagcaaaaagatgaaatccagcagcttctttataaagaatgtcggcttggcatatatgctgatgaaaaagctcaaaaaggaacctgttatattgaaactccttttggcagggtagatgcgagtgttgacacacaattgatgcaattgaaagataaacttctgacagcgctggaagcaggtgcagctgaatgaagacacagagtctgatagattgtatagaaatgacagactcgtataaacggtacggaaaagtcaagcgggtcatcggcctgatgattgaatcaaaagggccagcaagctcaattggcgacgtgtgcctgatttatgcaaaaggacaatctgggaaagtcattaaagctgaggtagtcggcttccaggaagaaaatattttgcttatgccttatttagaggctgcgagcattgcacctggcagcattgtagaagctactggggaatcacttcgggttaaagttggaaccggactgattggacaagtcatcgatgcttttggagaaccgcttgacggaaaacttctgcctaaagggctttcgcctgtatcaacggagcaatcaccgcccaacccgatgaaacggccgcctatccgtgaaaagatgggtgttggagtcagatcaattgacagcttgctgacagtcggtaaaggccagcggattggaatttttgcaggaagcggtgtcggaaaaagcaccttaatggggatgatcgccaagcagacagaggctgacttaaacgtcattgcacttgtcggagaacgcggacgagaggttcgggagtttattgaaaaagatctggggaaagaggggctgaaacgatcgattgtagtcgttgccacctcagaccagccagcattaatgagattgaaagcggcatatacagcgactgcaattgccgagtatttccgagataaaggccaaaatgtcatgtttatgatggattctgttacaagggtggcaatggcgcagcgagagattggactggctgcaggagagcctccgacgacaaaaggttatacaccttcagtgttcgctattttacctcgtttactagaacgaacaggtgcaaacgagcatggaaccattacggcattttatacagtgttggtagacggggatgacatgaatgagccgattgccgatactgtacgcggaattttagacggacatattgtgttggacagggcgcttgccaataaaggccagtttcctgcagttaacgtactaaaaagcatcagcagggtgatgtcaaacatttcaacaaaacagcatctggatgcggcaaataaattccgtgaacttttatcgacatatcaaaattcggaagatctcattaatatcggagcttacaaaagaggatcatccagagaaattgatgaagcgatacaattttatccgcagcttattcaatttttaaagcagggaacagacgaaccggctttattggaagaaagcattgctgcattaactagtttgacaggaaatgaggaataaacgtggcttatcaatttagattccaaaagctgctggaactaaaagaaaatgaaaaagaccaatccttatccgagtatcagcaatcagtttctgaatttgaaaacgttgctgaaaaattatatgagaatatgagcaaaaaggaattgctggaacaaaataaggaaaagaaattaaaaagcggcatgagtgtacaagaaatgaggcactaccaacaatttgtctcaaatcttgataatacgatctatcactatcaaaagcttgtcattataaaaagaaatcaaatgaatcaaaaacaagaaattttgacagagaaaaacattgaagtgaaaaagtttgaaaaaatgcgtgaaaaacagtttaaaatgtttgctcttgaagataaagctgcagaaatgaaagaaatggacgatatttcgattaagcagtttatgattcaaggccattaggagcgaatgtaatgtccggcaaaaagaaagaatcaggtaagttccgttcggttttgcttatcattatcctcccgctgatgtttctattaatcgcaggggggattgttctttgggctgctggtatcaatgtcataaagccgatacaggatgctgcggcaaaaacgccggttcttaaagaattggtccctgaaaccgaaaataaaaaaggcgcagcatcaagtaaggatagcagtaatacggcagctctggaaaagaccattaaggatcaaaaaagtgaaatcagtatattgaataaagatttagaaacaagtaaatcagaaatcgataggctcaatcaaaagatccgttcacttgaaaagacggctgaggatcaaaaaaagtcatcagaagatcatactgaaggatcagcagactcgaaagcttcttctgaaaatgacaaagtgatcagtgtgtacaaaagcatggacagcggaaaggctgctaaaattattgcccaattaaaggagcaagaagcactgaaaatattgaatggcctaagcaaaaagcagcttgctgacatattggcgaaaatgactcctgagcaagcagcaacctatacagaaaaaattgctgccagccaagaatagggggaatgaaaggtgaagctgcttgaattagccggacctttgctgcaaaccacaacgggttctgccgctaaaaacatgaaaagtagccaaggagtttttcaaaactggcttatgtctgaggctggattgaaggaactttcagaacaaggaaagggtactcctaattccgaagatcagcttttagcagatgcgcttaaaaagatcggtgactggctaaatgcaagtcctgaagatcaagacaaacaaaatgcggatcttttgcaaacattaagcaaactgacagggaagcaattggatgcgaatgctctgcaaatgttgcaaaatcttttgcaagcagttgaatcaaaaatgtcaggcgggacggatcaattgctcacagaaacggagaaaatcttttcagaagctaaaacggctctgagtgccaatgattctgcttctgacattaatggagcactgaagtctgatacagagcaatcaaatcaggaaaatgaagtatccgagcctgctaaagagcttatctatatccagatgttcattagccagctcgtagaagggaataagctgactgatcgcgggaatggcaatgaagctcatgccatttaccaaaatggagatcaattcctttctgcattagaaaagaagggtgtatctcaacaactaattcaggatcttaaacagcaaatattcactaaagctgagtcaagttcaaaactttactcgatgacagcgtcagagctgaaaagttttcaaagcttaatggatcaaatgtctatgcttcctcaaaaagggaccaaagaatggagtttagctgaaagccagctgaaagccttcttgttatcgaaatcatccgaatcatcacaagactttgggaagcgtgttctcacaccgctctcgcagagttcatccagcaaaaatgcatcggatgtttctggaagtattcagcctgtagatagtaaatcaggactccaaatgctgttttcggggtatcggggcataggaggagttcaaacacttgatctgcagcagatgtcatctgatataccaaatgccgaaacaaaaacggtggctgatcaagtgattaatgcgtggaagcagatgaaatatacgcctttcggcagatcgacgggaagtttcactattcggctgaaccctgaacatttaggatttgtcacaatcaagctgacaaatgaaaatggaatgtttcagagtaaaatcatagcatctagccaatcagcaaaagaattgcttgaacagcatcttcctcagctgaagcaatcattgccgaatatggccgtccaaattgaccgttttactcttccggtccaaagcggggatcagccgatatacggccagcttgctgatgaacagaaacagcagcaagaggggcagagacagcaaagacagaaaaagcaatcaaatgattttggcgatctgctcgatgaagtgtcgatggttgaaatggaggaagaagaatgacttctataagttcagaatataaactgcctgaaaaaacgaacactgtgtcgacgaacaacagcagcttggggaaagacgagtttttaaaaatattaatgactcaagttcaaaaccaagatccgcttaacccgattgacgataaagaatttatcagccagatggcgactttttcaagcttggagcaaatgatgaatctgaatacgacaatgactcaattcgttgaaaaccaagatccgtttacaacgtatgttgattggatgggaaaagaagtatcttggactgatggtaaaagtgcaacagataaaacaggcacaataagctctgttaaacattttaaaggaaattattatctcgttcttgatgatgggaccgagatcagtcctgcgaatgtcatgtctgtgggacaatcatctaaataaaaacatctgggggaatatattatgttacgttcactttattctggaatcagcggtatgaagaactttcaaacaaagcttgacgtaatcggtaacaacattgccaacgtaaatacagtaggattcaaaaagagccgtgtgacctttaaagatatggtaagccaaaccattgccggcggttctgctgctggtgcaacaatcggcggaacaaactctaagcaaatcggtttaggttcatcatctggcacaattgatacaattcattcaacaagcgcgacacaaagcacaggaagaacacttgatttagcaattgacggcgacggttacttccgaattgatacaggtgacgggacagcttatacaagagcagggaacttctatttagataatactggaacactggttacaggtgatggctaccatgtactaaatatgaatggcggaacaattaaaattcctactgatgctcaaagctttagcattggttctgatggaaaggtgtcaattgttgatgctgaggggaaaacacaagacgggggacaaatcgggattgttacttttgccaacagtgacggcttagataaaatcgggagcaacctataccgtgaatctttaaactctggaacggccagtgcagcgaaccagcctggtgacggcggaactggtgctcttaaatcaggatttctcgaaatgtctaacgtcgatttaactgacgaatttactgaaatgatcgtagcccagcgcggattccaatcaaactcaaaaattattacaacatctgatgaaatccttcaagaactggttaaccttaaacgttaaggagggaggggaggcgagtaatcgcttctccgctgttttatgattaaagtaacccgtttgaacgggcagccctttacactgaatgcgctatttattgaacagattgaatgttttccggatactacaattactctgtcaaatggtaagaagtttgtagtaaaagaagatgaagaagctgttctggaaaagatcgcagctttctaccgaaaaatacaaatatttgcaatggatcaaggaatagaggaaccggaatgaagaaaaagttaatgatcatattactaattattcttatcgtaattggtgctctcggggcggcggcttattttgttttaggcggaaagtccgaaaaaagtgaagcgaaaaaaagtattgatgaaatcgttgcgtcttctgttgatgtagaagagatcacaacaaatttaaagtctgataacattatccgtcttgctattaaacttgaaactgattctgataaatcaaaagaagaacttgagaaacgtgatttccaagtgaaagacgctgttatatcactgctggctgatacgaatgctgatcagattgagggagacaagggaaaagaaacctttaagaaggaactaaaagataaaataaatagctacctccaagaaggaaaagtagaaaaagtgtatattacctcctttaatctgcaataaagcataatttgacagaatacggaggtgaggaaaatgtcaggagaagttctctcccaaaatgaaatagatgcactgctctctgcaatatcaactggtgaaatggacgctgaagagctgaaaaaagaagaaaaagagaagaaagtcaaggtttatgatttcaaacgtgcgctgcggttttctaaggatcagatccgcagtttaacgagaattcatgacaattttgcaagacttcttaccactcatttttctgctcagctcagaacctatattcacatatctgtcagttctgttgatcaggttccgtatgaggaatttatcagatcgattccaaacatgacgattctgaatctatttgatgttcatccgatggaaggaagaattatgatggaggtcaaccccacgatagcttatacgatgatggatcgagtcatgggcgggattggaatcagtcataacaaggttgacagtttgacagaaattgaaacaaaaatcatttctaatttatttgaaaatgcactgggtaattataaagaagcttggcagtcaattgctgatattgaaccggaaatgactgagtttgaagtgaatccgcaatttgttcagatggtatctcctaatgaaacagtcgtggtgatctcgctcaatactcaaattggtgaaatcagcggtgtcattaatctctgtatcccgcatattgtactcgagccgctcataccgaagctttcagtccactattggatgcaatcagaccgaaatgagccaaagcctgaggaaacaaagtcgcttgaaaaacgtatcatgacagcacaaatacctgtcgtggccgagctcggcacatctgaactgacgatagaagagtttttaagtttagaagtcggagactgcataactttggacaaatcagtcacggatcctcttactgtattggtcggagataagccgaaatttttaggacaagccggccgggtgaatcgaaaacaggcagtgcaaattttagatcacgacataagaggtgaacaagatggagaataatagattatctcaagatgagattgacgcgcttcttaacggtactggcagcacgcttgatgagccagagattccggaagtagatgacttatcggaaatggagcgtgatgcgatcggtgaaatcggtaatatttcattcggcagttctgcgacagcactgtcaacgcttttaaatcaaaaggtcgatattacgactccaagcgtaacggtcattccaagaagtaaaatcagcgatgcgtttcctgaaccgtatgtagcgattgaagtgaattatacggagggcttcagcggaagcaacctgttagtcgtggaacaaagtgacgcggcgatcattgcggacttaatgatcgggggagacggaaaaggtgcggacccttcactgggtgaaatccatttaagtgcggttcaagaagcaatgaaccaaatgatgggatcggctgccacatcaatgtctactgtattcagtaaaaaaattgatatttcacctcctcgggttgaattgctggatgttactgaagaaaagggtacagaccgtattcctgatgatgaaatgctggtgaaagtttctttcaacttaaaggtgggagaattaatagactccagcattatgcaactttacccattgacatttgcgaaagatttaatttcaagccttatgaactcagaaagtgcagaggaagaagaaacggtgcagcctgaagttacatacgaacagccgaaagagcctgtgacgccagagccgcgtattgaaccgaagcaacagcagcagccgccaaaaaggcagggaacagcaaaaaaagcagcgccagttcaggtttcaccggtggaattttccgcgtttgatccaaacgaagctgtacaagcccctattcataatctggatatgcttttggatatcccgctttcgattactgttgagcttggcagaacgaagagaagcgtaaaagagattttagagctttctgccggaagtattatcgagcttgataaattagccggtgagcctgtagatattttagttaatcagcgtatcgttgccaaaggcgaggtcgttgtcattgaagaaaacttcggagtaagagtcactgacattttaagccaggcagagcgcattaataatttaaaataacgaaacacaaggagagagatagattatggcacatagaattttaattgtagatgacgcagcatttatgcgaatgatgattaaagatattttagttaaaaatggttttgaagttgtggcggaagctgaaaatggagcacaagcggtagagaaatataaagagcattcacctgaccttgttactatggatatcacgatgccagaaatggatggtattacagcattaaaagaaattaaacaaattgatgcgcaggcaagaatcatcatgtgttctgctatgggacagcaatcaatggttattgatgccattcaggccggcgctaaggatttcattgtgaaacctttccaggctgaccgtgtgcttgaagcaatcaacaaaacattaagttaaagggtgtacgactgttgaaaaagagtcaatattttattgtttttatttgttttttcgttttattcagtgtacatccgattgctgctgccgcggcagactctgataattcaactgtaaacgaatggtttcaaaagaaagatgaaaaaactgcagatcaatcagagcaaaagaaagaaaaaacaacaaaaactgctgatgagacggagggagcggctgctccttctgtctcagcttttgattttgtaaagatgattttcgctttattgtttgttatcgcgctgatttacgggctggttaagctcatgaacaaaagaaatcggctcctaaagccttttcaatatgttgaaaatattggcggcacatcggtcggccagaacagatccatacaattgatcaaggtcggaaaaagtgtgctcatcgtcggtgtaggagagacgatccagctgctgaaagaaattgaggatgaaaaagagattgaagtcattctcagtcagcatgaagaggcaatgtcaagcaaaatagagtggcaaaagtttgtgaagccgcttaagagttctgaacatcagccgcagcaaaaactgccttcattttcaaaagcattaaaagagcaacttgaagagttaaaacaaaaccgttctgaaggaaagaagaaaggcccacgtcatcatgaatgagtttataaatattttcagttcaagcgatccggaaaacgtaagttcgactgttaaattactattattgttaactgtattttcagtggcgcctggaatattgattcttatgacttgttttactcgcatcgtcattgttctgtcatttgtcagaacttcacttgcgacgcaatctatgcccccaaaccaggttctaatcgggcttgcgctgtttttaacattttttattatggctcctactttttcagaaattaataaagaagcgctgaccccattaatggacaacaaaatcagcttggatgaagcgtatacgaaagctgaggaaccgattaaagaatttatgagtaaacacacaaggcagaaggatctggcgctgtttatgaattacgcgaaaatggataaacctgaatcattaaaggatattccgttaacaacaatggttccggcttttgccatatcggagcttaaaacagcatttcaaataggttttatgatttttatcccttttttaattatagatatggtagtggcgagcgtcttgatgtcaatgggaatgatgatgctgcctccagttatgatttctctgccctttaaaatattactttttgttttggtagacggctggtatttaattgtgaaatctttgcttcagagcttttagggtaggtgctaaacgtgagttcagaatttgtaatttctatggcggaaaaagccgtatacgtaacgctgatgatcagcgggccattattggctattgctttactggtcggtttaattgtcagcatatttcaggcgacaactcaaatccaggaacagactttggcgtttattccgaaaatcgtggcggttctcctggctctcattttttttggtccgtggatgctgtcgacgattctttcatttacaacagagctgttttctaatttaaatcgttttgcagggtaatgtagagatgaattcaattattgacttatttcctgcttttttattggtttttattagaatctctgctttttttgtaacgattccgctatttggacatcgaaatgtgccagctgttcatcgcataggttttgctttttttcttgcggtcatttgtttcagcaccattgataaaccgccctctttggagatagatgagcactatatgcttttggcgtttaaagaagctttggtcggcctatgtctgggtttaattgcttatatgatgattgccgcagtgcagattgccggctcgtttattgattttcaaatgggattttcaatagcaaacgttattgatccgcaaaccggtgcacaaagtccgttgattggccagtttatctatacgatggcacttttgtttatgctaagtgtcaatgcccaccatttgttgctggatggtatttactacagctttcagtatatttcagttgatcaggcatttccgaatttcggcgatgaaaagtttgcctattttattgcgaaaagctttaatgcaatgtttattatcgcttttcaaatgtcagcgccggttgtggccagtttgtttctagttgatttagcattaggtatcgtggctcgaactgttccgcagttaaatgtatttgtggtcggtctgcctttaaagatcgctgtcagtttcattatgctcattgtatgtatgtccgttatcttcgtcgttgtccggaatgttttcagtttaacgattgaaacgatgcggaatcttttagcattggtcggtgtttcttaatgaagcttagagttgacctgcagttttttgcgggagagaagacagaaaaagccactccgaaaaaacggaaggatacgcgaaaaaaagggcaggtagccaaaagctcggatgtcaataccgccgtttctttactggtaatattcctttcgcttattgcaattggtccgtatatgagagacaggctgctgtcattcatagaaacattttataccgaatcgctcacaatgaagctctcagaatcaaatgtgcatacattgtttgtcagcttattaaaggatatgggcatgatactcgcaccgatcttgctagttgctcttgttgcaggagtcgtaagcaactatatgcaggttgggttcttattttctgctgaagtgatacagcctaagcttgaaaaactggatccgatcaaaggctttaaacgaatatacagtatgagggcgattgtagagctgattaaatcaattttgaaaatcgtagtcgttggttttgcggcttttgctgtgctttggctgcattatggagaaattctccggcttcctctcctgacacccgaagaggcactttctttcgtttcaaaactcactttgtggatgggactaagcggtgcaggtgcattgttgattcttgctggtctcgactatttatatcagagatttgactatgagaaaaatatcaaaatgtcaaaacaagatataaaagatgagtacaaaaaatctgaaggagacccgattatcaagtctaaaattaaacaaagacagcgggaaatggcgatgaggcggatgatgcaggaagttccaaaagcagatgtcattatcacaaacccgactcactatgcgattgctttgaaatatgatgaagaaaaaatggacgcaccttatattgttgcaaaaggcgtcgaccaccttgcgttaaaaatcaggaaaattgctaaagagcatgatgtcatgatggtagaaaacagaccgcttgcccgtgcgttatatgatcaggtggaaattgaccaggcagtgccggaagaattttttaaagttttagcagaaattctggcttacgtatataaaacaaaacaaaaagtatattgaatttttcgatttaaaaggagagaaaaaacagcatgtcaacaagagatttatccgttttaataagtgttgtcctcattgtggcgatgctggtgattccatttcctccatggctgttaagtattttgatcattattaatatttctcttgcattgatcgtgcttctcaccacaatgaatatgcaggaagcgcttcagttttcgatttttccgtcactgttgctgcttttgaccctatttcgtttgggcttgaacgtctcaactacccgttcaattctttcacacggtgaaggaggtaaagtcgtcgagactttcggaaatttcgttgtcggcggaaatgtattagttggactcgttgtatttatcatccttattattattcagtttatcgtcattacaaaaggtgctgaacgtgtttccgaggttgcagcaaggtttacgctggacgcaatgcctgggaagcagatgagtattgatgctgatttaaacgcagggatgattaccgaacaggaagcgaagcatcgccgcgaaaaagtggcaagagaagcagacttttatggagcaatggacggtgccagtaaatttgtaaaaggtgacgccattgccggaatcatcattgtgatgatcaatattattttcggaatcgtgatcgggatgcttcagcagggcatgtccattcaagaggctgcttcacactttacgatgctgactgtaggggatggaattgtttcgcaaatcccggcactgttaatttctacggctacgggtattgtggtcacaagagctgcctctgaaggaaacttagggcatgacattacaggccagctgtttgcgtatccaaagcttttatacgtcgcagcagctacgatcatgcttttaggtattttcactccgatcggcatccttctgacggggccgcttgcgggattgcttgcttttggcgcatatacactatctaaatcaggtaaggaaaaagaagaagtggatgagattcttgaggaagaggctgaggtggacgagcttaaaagccctgaaagtgttgttcagcttctgcatatagatccgatagaatttgagtttggatatggcctgataccgcttgctgatgccaatcaaggcggtgatttattagaccgaattgttatgatacgccgtcagttggctttggaactcgggcttgtcattcctgtcgtgcgaatcagagataatatagcgttgcagcctaatgaataccgattgaaaattaaaggaaacgaagtagcaaaaggcgagttgttgcttgatcattatttagcgatgtcgcctactcctgaggacgatctcattgaagggattgaaacagtggagccttcattcgggctgccggctaaatggattagcgaagcggtaaaggatgaagccgacatgcttggttatacagtagttgatcctgcatcagtcgtttcaacgcatattacggagaaaattaagcagcatgcccacgaattgatcggaaggcaggagacaaaacagctgatcgatcacttgaaagaatcgtatccagtcctggttgaagaggttacgccgaatccattgtctgtcggtgatattcagaaagtgcttgctaagcttttaaaagaaaaagtttcaattcgaaacttagtaacgatttttgaaacacttgctgactatgggaaattaacaacagattctgatcttttgacagagtatacaagacaagcgcttgctaaacaaattacagcccagtttgccaaagaaaatgaagtgttgaaggttgttacttgttccggccgtgtagaaaaagcaatagcagacggtgtgcagcagacggaacacgggaactatttatcacttgaaccagatatttcagaaagtatagtgcgctctgtcgccaaagaagctgaacagctctcattacgtcaggaaaccgcgattcttctttgctcgccgcctgtcagaatgtatgtgaagcagcttctggaacggtacttccctgatcttccggtactctcttataacgaacttgaggcgaatgttgaggtacaaagcattggagtggtggatatttaatgaaaataaaaaaatttactgctgcttcaatgcaagaagcggcacttctcatcagaaaagagttaggtaatgaagcggtcatattaaattcgaaaaaaattaaaaagcgaaaatggtttggcctcgtcaacaagcctgctgttgaagtaatcgccgtattggatcaggactttcttgagaaaaaaacgcctcagaaggcagctgaaccgaaacaaacattaaaaactccggtcagcagtccaaaaatagaggagagaacatatccccctcaaattccggcgcaacaggagctaggtgatttttcagcatatcaatctgtacttcctgagccgctgcgaaaagcagaaaagcttttgcaagaaacagggatcaaagagtctacgaaaacgaacactctgaaaaaattgcttcgcttctctgttgaagcaggcggcttgactgaagaaaatgttgtcggcaaacttcaggaaatactatgcgatatgctgccctcagcagacaagtggcaggagccaattcattcaaaatatatcgttctctttggttcaacaggggctggtaaaacaactacactggctaaactcgcagccatatctatgcttgaaaaacataaaaaaatcgcttttattacaacagatacgtatcgtattgcagctgttgaacagttgaaaacatacgctgaactgctgcaggctcctctggaagtttgctatacaaaagaagaatttcagcaggcgaaggagctattttctgagtatgatcatgtgtttgttgatacagctggaagaaacttcaaagacccgcaatacattgatgaactgaaagaaacgattccttttgagagcagcattcagtcatttcttgttttatccgcgactgcaaaatatgaagatatgaagcatattgtcaaacggttttcatccgtccctgtcaatcagtatatttttacgaaaatagatgaaacgacttccttaggttctgtatttaatatactggcagaatcaaaaataggtgtcgggtttatgactaacggccagaatgtgcctgaggatatacagactgtatctccacttggttttgtgaggatgctgtgcagatgaacagatatgaccaagcagcaactttacgggcgaaaatggaaaaacgtgagcgcgttctgccaatggtttattcacaaaaagcgaagacacttgctgtcatcagcggcaagggcggtgtcggaaaatccaatattaccttaaatatggcacttgcgctgcaggataaaggtaagaaggtgctgctcatcgaccttgatatcgggatggggaacattgatatattaataggaaattcatcgtctgccacgataatcgatgttttaaccgatcgtcagcctttgctgcagtcattatccgttggcccaaagggtttgcggtatatatcagggggaaccggtcttgatgtgatgtttcagctcgatcagagaaaatggacgttttttgccaatgaactttctcatgcattaagccagttcgattatgtgctgtttgacatgggagcaggcttatcaaaagatcaactgccttttattttatcagcagaagatattttgattattacaactcccgagccgacggccattatggacgcatacagcgctgtcaagcacttggttttgacagaaaataagctttcaatgaaggtggctgtcaatcggtgccgtgaccaaaaggaagggcttgacgcttttgcccgcctctcccgtacaattcatatgtttttggatgttcaggttcagtttgccggttccgtttctgacgatgtgatcgtgagcaaagcggttgtcgaacaggttccttttttcataaaaagccctcaggcaaaagccagccggtcagtccgtattttagcggacgccttgtttgaaagagaagaaacgagacacaaagaagacaaacagacatttattgagaaattatcttcttttttaatgaggagggcttaatttgattcgtgtgcttgtagttgatgattcagcttttatgagaaaaatgataagtgattttctgaccgaagaaaagcagatagaagtaatcggaactgcgagaaacggagaagaagcgcttaagaagattgaattattaaaaccggatgttattactcttgatgttgaaatgccggtcatgaatgggacagatacgctccgcaaaattattgagatttataacttgccggtcattatggtgtctagccagaccgagaaaggtaaagaatgcacaattaattgtttggagatcggtgcctttgactttatcacaaagccatcaggctcaatatctctggatctatacaaaattaaagaacaactagttgagcgtgtcgtcgcggcaggactttccggcaagcggaaacgtcctgtttcccagacagttcggcccgaacctattgtgcgtgctgtcgttaagcctgaattaagcaaaccgaaacctggcacgggcagacaaattgtgtgtatcggcacatcaacaggcggtccacgggcgttacaaaaggtgataccgaagctccctaaggatttgaacgcaccagtggttgtcgttcagcacatgcctgaagggtttactgcttctttggctgatcggctgaatcatttatctgacattcaggtaaaagaagcaaaagatggtgaagcagctcttaacggctgtgtttacatagcaccgggcggaaaaaacatatccgttattaaaaacagcgaaggactccaggttgtgcttgataaccatgacacaccaagccgtcataaaccatctgctgattatttattccgttctgtcgggaaactgacagattatgaaaaagtagcggttatcatgaccggaatgggcagtgacggcactgctggactaaaggacatgctaacagccggcaatgtgaaagccattgcggagtctgaagaatcttgtgtcgtatacgggatgccaaaagctgctgttaaagcgggtctcattcatgagattaaacatgtggaagatatcgcagcatccatcacaagctgtgtgaaaaaagagagggtgtgattcaaatggatatgaatcagtatttagatgtctttattgatgagagtaaagaacatttacaaacatgtaatgaaaagcttcttcttttagagaaagacccgactgatcttcagctcgtacatgatatattcagggctgcccatacattaaaaggaatgagcgcaacgatgggctacacggatttagcacatcttacccatctgcttgaaaacgtgctggatgcaatccgaaacggagacatggaagtcacctcagactggctggatattttgtttgaagctctggatcacctggaagcaatggttcagtctattattgatggcggggatggtaaaagagatatctcagaagtgagtgccaagcttgatgtgaatggtgcgcacgctgaatccgctgcctccgctgaacctgcagaagcacagagttcagcatctgattgggaatatgatgaatttgaacgcacagttatacaagaagcggaggagcaaggcttcaaacgatatgaaatcaagatttctctgaacgaaaactgtatgttaaaagcagttcgtgtctatatggtgtttgaaaaactaaatgaagtcggagaagtagccaaaacaattccaagtgctgaagtgcttgaaacagaagattttggaactgactttcaagtttgtttcttaacacatcaatcagcggaagacattgaacaattaatcaatggcgtgtcggaaattgagcatgttgaagtcattcaaggggctcctttaacatcagctgaaaagcctgaagaatctaagcaagaagattcaccagcagcagctgtacctgcgaagcaggagaaacaaaaacagcctgctaaaaacgatgaacaggcgaagcattcagccggcggatctaaaacaattcgtgtcaacattgacaggcttgattctttaatgaacttatttgaagagcttgtcattgaccgcgggcgtctcgagcagattgcgaaagagcttgagcataatgaactgactgaaacggttgaacgaatgacgagaatttccggagatttgcaatcgattattctgaatatgagaatggtcccggttgaaactgtttttaacagattcccgagaatgattcgccagcttcagaaagagctgaataaaaaaattgaactctcgatcatcggtgcggaaactgaactggatcgtacagtaattgatgaaatcggagatccactcgttcacttgatcagaaacagtattgaccatggtatcgaggcgccggaaacacgtttgcaaaagggaaaaccggaatcaggaaaagttgtgcttaaagcttatcacagcggcaaccatgtctttatcgaagtagaggatgacggcgcaggccttaatcgaaaaaaaattctggaaaaagcgcttgagcgcggggtcataacggaaaaagaagctgaaaccttagaagacaaccaaatttacgaattgatttttgctccggggttctcaactgctgaccaaatttctgatatttccggccgcggtgtaggacttgacgttgtaaaaaacaaactggagtctcttggcggttcagtcagtgtgaaatcagccgagggtcaaggctctctattcagcatccagctgccgcttaccttgtctattatttcagttctgctgattaagttggaagaagagacatttgccattccgatttcttcaatcattgagacagcagttattgacagaaaagacattttgcaaacgcatgaccgtgaagtgattgactttagagggcatattgtccctgtcgtttatttaaaagaagagtttaaaatagaagatacaagaaaagatgcggaacagctccatatcattgtcgtgaaaaaaggcgacaaacctactgcatttgtggtggactcctttattggccagcaggaagttgtgctgaaatcactcggagattatttaacaaacgtctttgcaatttccggagctactattttaggagacggagaagtagcgctcattattgattgtaatgcactgattatttaaccattcgaggaggtgtctcacatgactgcagaaattaaaacaggcgaaaaaatgatagtctttatggtaaatggcaaagaatatgccatttccgtcactcaggtgaaatcaattgaaaaatggcaaaagccaacgagggtacctggcgtcgaaccatatatttgcggggtaatcaatttacgcggggtggtgactccggttattgatttaagaaaacgcctgaatttgccagagtatgaaattacagatgaaacacgaattatcattattgcttatcgtgatattgaagtcggctggattgtggatgaagcgaatgatgtgattaccgtacacgaaagtgaaatagaatctgctccagaaggcgttcagaaagatacggatgtgtcgatcgaacagattgtgaaacaagagaacagactcttaaatattattgatgcgaacgcggttttggataaagaatcatctcagtccgctgtgcccgatcaagcttaatcttaaaggggttatgacatgagtatttttaatggaatcaaagaagagcagatggacattttgcgggaagtcggcaatataggcgccggccactccgcctctgcaatggcccagctgttaaatagaaagatagatatggaagtcccatttgcaaagctgctgtcttttgatgagcttgttgattttttcggcggcgccgatgtcccggttgccagcatctttttaagaatggaaggcgatttaacgggttcaatgttctttataatgcctttttttcaggcggagcagtttatcagagagctgattggaaaccccgattttgacatagaggacttaggtgaagaccacatgagctcatccgctttgcatgaactgggcaatattttagcggggtcatatttaacagctttggcggatttgacgaaactccagctctatccaagtgttcctgaagtctctttggacatgttcggagcagtgatcagcgaagggctgatggagctcagtcaggttggagaacacgccattgttgtcgacacgtcaatttttgaccaaagccatcagcaggagctgaaagcgcatatgtttatgctgccggactatgattcatttgaaaagctctttgtcgccttaggtgcatcattatgagtacaactgaggctgttgttataaaggttgggattgctgacgtgaagatcgcccgcttcccggataccatccggacctctggtttgggctcatgtgtggggctggtgctttatgataaagaaaagcaaacggcgggtcttgttcatgtcatgcttccggattcgacgttatcgaaaactgccgagctcaaccgggctaagtacgctgacaccgccgtacagaccacgattgatatgctgatagaagcgggatgccggaaatttgcattaaaagcaaagctggccggcggatcagagatgtttaaatttaaatcgacaaatgatttgatgaagatcggaccgagaaatgtattagcgataaaagaacagctgtctttatttaatattcctattattagtgaagatacgggcggctcaagcggccggacgatagaatttgaaccgaagtcctgcatgctgcatattcgaactgttaaacaaggtgaaaaaacgatttaattaaggtattagggggataacaatgcaatccttgaattatgaagatcaggtgctttggacgcgctggaaagagtggaaagatcctaaagccggtgacgacttaatgcgccgttacatgccgcttgtcacatatcatgtaggcagaatttctgtcggactgccgaaatcagtgcataaagacgatcttatgagccttggtatgcttggtttatatgatgcccttgaaaaatttgaccccagccgggacttaaaatttgatacctacgcctcgtttagaattcgcggcgcaatcatagacgggcttcgtaaagaagattggctgcccagaacctcgcgcgaaaaaacaaaaaaggttgaagcagcaattgaaaagcttgaacagcggtatcttcggaatgtatcgcccgcggaaattgcagaggaactcggaatgacggtacaggatgtcgtgtcaacaatgaatgaaggtttttttgcaaatctgctgtcaattgatgaaaagctccatgatcaagatgatggggaaaacattcaagtcatgatcagagatgacaaaaatgttccgcctgaagaaaagattatgaaggatgaactgattgcacagcttgcggaaaaaattcacgaactctctgaaaaagaacagctggttgtgagtttgttctacaaagaggagttgacactgacagaaatcggacaagtattaaatctttctacgtcccgcatatctcagatccattcaaaggcattatttaaattaaagaatctgctggaaaaagtgatacaataatgaatttcatggttagcgagtgaaaaacatgtcaacactattatggcttttaagctttacgctccacggcgttcttctgtacgctgtcattatcctgtatacgaggctcgctgcagtgaaagaaacagaaaaacagcaaaaacagatacttgaagagacggaaaacaccttggcggcatttctgcttgaattaaaagaagaaaatgagaaactgatagaaaataaagcttcatctgcaagtcaatacgatgaagaatcccaaaagccaggccttcagccctctgaaacatatcaagagcgggatccagtccaagaggcagagaatcttcctgaacatattgaaggtctgattacagaggttgaccgtcgggaagagatcgtaaacagtgaggtccaatcatttgaagaccaggtcatagaattatatgaacagggatattcggcaagtcaaattgcccagaaaatgaagagcggaaagacagaaatcgagctatttttaaaatttcgctccaaaggtgtaaaggattcttgattgtcggataaagctgtgttatattatgtcttggtgttaaatacacacgcttaacgatttatgcagagggtgctgcaggcggcagttctgcacaaaaatgacctaagcggaggaaaaaaaccattatattaggaggaaataacatgtcagtcatttctatgaagcaattgcttgaagctggtgttcacttcggtcaccaaacacgccgttggaacccaaaaatgaagcgttacattttcacggagcgtaacggaatctacatcattgaccttcaaaaaacagtcaaaaaagtagaggaagcttacaacttcactaaaaatcttgctgctgaaggcggaaaaatccttttcgtcggaacaaaaaaacaagctcaagattctgttaaagaagaagctcaacgctctggcatgtactatgtcaaccaacgctggttgggcggtacattaacaaactttgaaacaatccaaaaacgtattaaacgtcttaaagacattgaaaaaatgcaagaaaacggtacgtttgatgtacttcctaaaaaagaagtcgttcaattgaaaaaagaattagagcgtcttgaaaaattcctaggcggaattaaagatatgaaggatcttcctgatgcattattcatcatcgatcctcgcaaagagcgcatcgctgttgcggaagctcgcaaattaaacatccctatcatcggtatcgtagatactaactgtgatccagatgaaatcgatgttgttatcccagcgaacgatgacgctatccgcgctgttaaacttctaacttctaaaatggcagatgcaatcttagaagcgaagcaaggcgaagaagaagcggaagttgctgaagaaactgcaccagaaacagaaacaacaactgcgtaacctattcaaaaggtgataagagggactgccttttatcaccttttttcaagaaaaatgtgtaatatacatactcttgtttaaacatataaggaggaatacaaatggcaattactgcacagcaagtaaaagaactgcgtgaaaaaactggcgcgggcatgatggattgtaaaaaagcgttaactgaaactgacggagatatggacaaagcaattgaccttttaagagaaaaaggaattgcaaaagcagcgaaaaaagctgaccgtatcgcagcagaaggttctactcttattaaaactgacggcaacaaaggcgttatcctagaagtaaactctgaaactgatttcgttgcgaaaaacgaaggttttaaagagcttcttaacactttagctgaccaccttcttgcaaacacgccagctgatgttgaagaagcaatgggccaaaaaatggaaaatggctcaactgttgaagagtacatcacaagcgcagttgctaaaatcggtgagaaaatcactcttcgccgctttacagttcttacaaaagacgacagctctgcattcggtgcgtaccttcacatgggcggccgcatcggtgtattaactgttctcaacggtacaactgatgaagaaactgcgaaagatatcgcaatgcacgttgctgcagttaaccctcgttacatttctcgtgatcaagtatctgaagaagaaacaaatcatgagcgtcaaatcttaactcagcaagccctccaagaaggcaaacctgaaaacatcgtagcgaaaatggttgaaggccgtctgaacaaattcttcgaagaaatttgtctattagaccaagcgttcgttaaaaacccagatgaaaaagtgaaacaagttattgcagcgaaaaacgctactgttcaaacttttgtccgctatgaagttggagaaggcatcgaaaaacgtcaagaaaactttgctgaagaagtaatgaaccaagtgaaaaaataatggtgaaaagatttcgcggctaagtcgcgtcttttcaggcagtataggggacacattttgtgttccctatttttaaaactatatttacaaacctttttttctcttgcataatagaaaacggcaatgtttacacttggaggttatcatggaaaaaccaaaatacaaacgtatcgtattaaagcttagcggggaagcattggcaggagaacagggaaatggaattaacccgactgtcattcaatccattgcaaagcaagtgaaggaaatcgctgagcttgaagtcgaagtggctgttgttgtaggcggcggcaacttatggcgcggaaaaacaggaagtgacctgggcatggaccgcgcgactgctgactatatgggaatgctggcgacagtaatgaattcgcttgctcttcaagacagcttggaaacactcggaatccagtccagagtgcaaacatccattgaaatgagacaagttgctgaaccgtacataagaagaaaagcgatacgccacttagagaaaaaacgtgtcgttattttcgctgcgggcacaggaaacccatatttctcaactgatacgacagctgcactgcgggctgctgaaattgaggcagacgttattttaatggctaaaaataacgttgacggtgtgtataatgctgatcctagaaaagatgaatcagctgttaagtatgaatcactttcttatcttgacgttcttaaagacggcctggaagtcatggattcaacagcttcctctttatgcatggacaatgacattccgcttatcgtcttttctattatggaagaaggaaatatcaaacgtgccgttatcggtgaatcaatcggaacgatcgtgagggggaaataacgtgtcaaaagaagtattaactcaaacaaaagaaaaaatggaaaaagcaattgctgcttatcagcgcgaattggctactgtacgcgcaggccgtgcaaatccatcattattagataaagtaacggttgaatattacggagcgcagacacctttaaatcagttgtcttctattaacgtgcctgaagctcgtatgctcgttatcacaccatacgataaaacagcaatcggcgatatcgaaaaagcgattttaaaagctgatttaggtcttacaccaacaagtgacggcaatatgattcgaattgcaattccggcactaacagaagagagacggaaagaattagtgaaagttgtaaaaaaatatgctgaagaagcaaaagtagctgttcgtaacgttcgccgtgatgctaacgatgatctcaaaaaacttgagaaaaacggagacattactgaggatgaactgcgtgcttccactgaagacgttcaaaaactgacagatgaatatgtgtcaaaaattgacagtgtcacaaaagacaaagaaaaagaaatcatggaagtttaatgaaaaactatgtacaatagataatagtgaaaagaccctctcatgtttacagggggtttttttgttaatactgttgattacattgattatcagcagggaatgtaacctttttgggtgacggaggaatctcatgctcaacatactcaaaaattggaagaatcagcaaactgcggcttccaacttagaacgttatacaaaagaagacatacttaagggagaaattcccgaacacatcgccattatcatggatggaaatggccgttgggctaaaaaacgctctcttcccagaattgcaggccaccatgaagggatgaaggtggtaaaaaggaccacgaagctcgcaaacgaattaggtgtcaaagtactgacattgtatgcattttcaacagaaaactggaaaagaccgaaaatggaggtcgattttttaatgaagcttccggaagaatttttgaatacgtatcttccagagcttgttgaggaaaatgtacaggttcggatcattggggatgaaacggctttgccggcgcacacattacgtgcgattgaaaaagctgtacaggacacggcgcaaaacgacggaatgatccttaattttgctcttaactatggaggccgtactgaaattgtcagtgctgcaaaatcactcgcggaaaaagtgaaggaaggctctttgaatattgaagacattgatgaatcgcttttttctacttatttgatgactgaatctttgcaggatcctgaacttttaattcgaacgagcggcgagataaggctgagtaattttatgctatggcaggttgcctacagtgaatttgtctttactgacgtcttgtggcctgactttaaagaagatcacttcttgcaggcgttaggagagtttcagcagagaggccggaggtttggcggaatttagaggatggtggacatgaaacaaagaattttgacaggtgttctggcagcaattgtatttttatttttggttattgtcgggaaattgccgttcaccatattaatttatgctatgagcagtgtggcgctttttgaacttttacggatgaaaaagctgaagctggtttcactgcctggtttgatcggtcttttattattgtggatgttcttattgccaagccagtattcgttttttgaagcggacgggatttccaaaatggaaatagctttatttgcggtactgctattgctgacttacacagtgttggtcaagaacacctttacttttgatgaagtcgggtttattacgcttgcagcaatttacatcggaatgtgttttcattattttatcgaaatcagaaatcttgaccaatacggattaacatacattttttatgcgtgtgttgtcatttggtccaccgattccggtgcctattttgtcggtaaatcgcttgggaagcggaaactgtggcctgaaatcagtccgaataaaacagtggaagggtttgcaggcggaattgtcatcgcacttgtattggcgacgatttttcagcttgttgcacaacttccgatcccgtatatctatctgctgttgatcacgctgtttttgtctgtttttggacaactgggagatttagtggaatccgccttgaaaagacattacgatgtaaaggattctgggaatattcttcccgggcatggcggtatattagaccgttttgacagtttcttgtttgtcatgcctttcttgtactttctgcttgcccttttttcataaaaaagtctaatatgaatatgagactgatcatgcagcaataagaataggagtagtggcaactttgaaaaatatttgtcttttaggagcaacaggatcaatcggcgaacagactcttgatgtactgcgtgcacatcaagaccaatttcagctggtatctatgtcgtttggcagaaatattgataaggccgttccaatgattgaggtctttcagccgaagtttgtctctgtcggtgatctggatacatatcataaattaaaacaaatgtctttttcttttgaatgccaaatcgggctgggagaagaaggactgatagaagcagcagtgatggaggaggttgacattgttgtcaacgctttgcttggaagcgtcggtcttatcccgacattaaaggcaattgaacagaaaaaaacaattgcgcttgcaaataaggaaactcttgtcactgcagggcatatagtaaaagaacatgctaagaaatatgatgttccgctgctgcctgttgacagtgagcattcagccatttttcaagctcttcaaggcgaacaggctaaaaacattgaacgcctcatcattacggcatccggcggaagttttcgggacaagacgcgggaggagctcgaatcagtaacagttgaagatgcattaaaacatccaaactggtcaatgggtgcaaaaattacaattgattcggctacaatgatgaataagggattagaggtgatcgaggcacactggcttttcgatataccttatgaacaaattgatgtggttttacataaggagagcatcatccattcaatggttgagttccatgataaaagtgtgatcgcacagctcggaactccggatatgagagtccccattcaatatgcgctcacttatcctgaccgattgccattaccagatgcgaaaaggcttgaattatgggaaatcggcagccttcattttgagaaagctgattttgacaggttccgatgcttacaatttgcttttgaatcaggtaaaataggaggaacaatgccgacagtgctaaatgcggcaaacgaagtagctgtcgctgcctttttagctggcaagataccgtttttggctattgaagactgtatcgaaaaggcactaacccgccatcaattactgaaaaaaccgagcctggcggacattcaagaagtggacaaagatacccggggatacgtcaattcaatactcacataaggtggtatgttcgtgaatacagttatagcgtttatcattattttcggaacgctcgttttcttccatgaactgggccatttattgctagcccaaagagcgggaattctctgccgtgaatttgcgatcggcttcggtccaaagattttttctttcaaaaaaaatgaaacagtttatacgatcaggctgcttccggtcggcggatttgttcgtatggccggcgaagatccggaaatgattgaggtgaaacccggatacacggtcgggcttctgtttaataaagaagatcaagttgagaaagtcatcatcaatcaaaaggaaaaatatccggatgctttagtcattgaagtggaaacagcggatctagagcatgacatgaagatcactggttatgaacaggggaaagaggacgaactttccagctttactgtcagcgaaacatccttttttattgtagacggagaagaagtgcagattgcgccgtataatcgccaatttggttccaaacctgtatggcagcggattaaagcaattgctgcagggccgattatgaactttattttagcttacgtcattttagtgatgcttgggctgattcaaggcgtaccgtcaaatgaacctatgctcgggcagctgacagacaatggacgggcggctgaagcagggctaaaagaaggggattatatccaaagcattaacggagagaaaatgaggtcttggactgacattgtctccgctgtaaaagaaaacccggagaaagaaatggacgttgcagtaaaaagagataacaaaacgcttcatatttcggtgactccggaagctgttaaagatgagaacaaaaaaacaatcggacgtttcggttcctatgcgccgactgaaaaaggcgtactctcagcggttgcttacggcgcgacatcaacagttgatgtcaccaaagccattttaaccaatctgagcaaattagtaacaggccaatttaaactcgatatgctgtcaggtcctgtcggcatatatgacatgacagaccaagtggcgaaaacagggatcgtgaacttatttcagtttgcggcgtttttaagcattaaccttgggattgtcaacctgcttccgattccggcacttgacggaggaagactgttgtttctatttattgaagcgattcggggcaaaccgattaacagggaaaaagaagcatttgttgtgtttatcggagtagctttcttaatgcttcttatgctggttgtcacatggaacgatatccagcggctgtttttgtaaacgaaaagtaaatcaatcagaggtgcgaagaaatgagacaaagcttgacgcttattcctacgctccgtgaagttccagctgatgccgaagcaaaaagtcatcagcttcttctgagagcaggatttatcagacagaatacgagcggggtatacagctatatgcctcttgcgtataaggtgattcaaaacattcagcagattgttcgagaggaaatggagaaaattgatgccgtagaaatgctcatgcccgcattgcagcaggcagagacatggcaggaatcaggcagatggtatacgtatggtcccgaactgatgagactaaaagaccgtcatggccgtgaatttgctttaggggcaacgcatgaagaggttatcacttcgcttgttcgcgatgaggttaaatcttataagcgtctccctctgactctttatcaaattcagtctaagttcagagatgaaaaacgtcctcgcttcggtttgttaagaggccgcgaatttattatgaaggatgcgtactctttccatgcatctgcagagagcctggatgaaacgtatcaaaaaatgtacgaggcctattctaatatttttgcccgctgcggcattaatgtaagacctgttatcgctgattcaggcgcaatgggaggaaaggatacgcacgaatttatggcactttctgcgatcggagaggatacgattgcgtattctgatgaatcacagtacgcggctaatatcgagatggctgaagttcttcaccaggaagttccttcagatgaagagcctaaagctctagagaaggttcatacgcctaacgtgaaaacaatcgaagaactgactgcgttcttacaggtttcggctgaagcgtgcattaagtcagtattgtttaaagctgatgaccgttttgtcttagtgcttgtaagaggggatcatgaagttaacgatattaaagtgaaaaacttgcttcatgcagaagttgtagagcttgctacacatgaagaggtcattcagcagctcggaacagagccaggctttgtaggccctgtcggtattcatcaggatgtggaagtatatgccgatcaagctgtgaaagcaatggttaatgctgttgccggggcaaatgaaggagatcatcattataaaaatgtcaatgtgaatcgtgacgcgcaaattaaagaatttgctgatcttcgttttattaaagaaggtgatccttcaccagacggcaagggaacgatccgttttgctgagggaatcgaagtcggacaagtctttaagctcggaacacgctattcagaagcgatgaatgcgacatatttagatgaaaacggacgcgcgcagccaatgctgatgggctgttacggaatcggtgtgtcaagaacgctttctgctattgctgaacagcatcacgacgaaaaaggcttaatatggccaaaaagcgttgcgccgtacgatcttcatattcttgctttgaacatgaaaaacgatgggcaaagagagcttgctgaaaagctgtatgccgatttaaaagcggaaggctatgaagtgctctatgatgaccgtgctgagcgtgccggcgtaaaattcgctgattcagatttaatcggccttccaatccgcatcactgtcggaaaacgagctgacgaaggaatcgtcgaagtgaaaattcgtcaaactggtgagtcaactgagatttcagtagacgaattatctgcgtttatcagcaagcagtaatcaccataacgatttatcaaaaaacatgttaaaatagaaataatagaaggtacctcattgcctgaggtaccttcacttatgatgtttttagggagggatactgtcttaatggaacagttatcagtaaacagaaggcagtttcaaattcttctgcagcagattaatatgacagatgataccttcatgacatactttgaacatggcgagattaaaaagctgacaattcacaaagcttctaagtcttggcattttcattttcaatttaaatctttgctgccttttcaaatatatgacacattaacaacgaggctgacgcaatcgtttgcccacatagcaaaagtgacatcttcaattgaagttcaggatgccgaggtcagtgaaagtatcgttcaagactactggtcacgctgcattgaagaactgcagggcatttcgccgccgattatcagtcttttaaaccagcaaaaaccgaagctgaagggcaataaactgattgtcaaaaccaaaacggatacagaagcggctgcgctaaaaaacaaatacagttccatgattcaagcaggctaccgtcaatttggctttccggatcttcagcttgatgctgaaatatttgtatccgagcaggaagttcaaaagtttcgggaacaaaagcttgcggaagaccaagagcgggcgatgcaggccttgattgaaatggagaagaaagataaagaaagtgatgaagaccaagcaccatctggtcctcttgttatcggttatcaaattaaagataacgaggaaatccggacacttgacagcatcatggacgaagaacggagaattacggtccaaggttatgtgtttgatgtggagacgcgcgagctgaagagcgggcgcacgctgtgtatcttcaaaattacagactatacaaatagtattttgatcaaaatgtttgcacgtgaaaaagaagatgcggcactgatgaagtctctgaaaaaaggaatgtgggtaaaagcacgcggaagcattcaaaatgatacatttgtcagagaccttgtcatgatcgcaaatgacgtaaacgaaataaaagcaaaaacccgtgaagattcagcacctgaaggagaaaaaagagtggaattgcatcttcattccccaatgagccaaatggatgctgttacgggtatcggaaagcttgtcgaacaggcgaaaaaatgggggcatgaggccatcgctttgactgaccatgctgtcgttcaatcctttcctgatgcgtattctgcggcaaaaaagcatggaattaaaatgatttacgggatggaagcgaatctcgtggatgatggcgtgccaattgcttataatgccgcacatcgtctgctcgaagaagaaacatatgttgtttttgacgttgagacgacaggattgtctgctgtatacgataccattattgagctggctgcagtaaaagtaaaaggcggagaaattattgataaatttgaggcgtttgcgaacccgcatcgtccgctttccgccacaatcatagagctgacagggatcactgatgatatgctacaagacgctccggatgtcgtagatgtaataagagatttcagagaatggattggcgatgatatccttgtcgctcataatgcaagctttgatatgggattcttaaatgtagcctataaaaagcttcttgaagtcgataaagctaaaaacccagtcattgatacgcttgaacttggacgttttctctatccggaatttaagaaccaccggttgaacacactttgtaaaaagtttgatatcgaactcacacagcatcaccgtgcgatctatgatactgaggcaaccgcttatttgcttctgaaaatgctgaaagacgcagctgaaaaaggcattcagtaccatgatgagttgaatgaaaatatgggtcagtccaatgcttatcaaagatcaagaccgtatcatgcaacattacttgccgtgaacagcacgggacttaaaaatttatttaagcttgtgtcactttctcatattcattatttttacagagtgccgcgtattccgagatctcagcttgagaaatacagggaagggctgctgatcggttctgcctgtgacaggggagaggtttttgagggaatgatgcaaaaatcgcctgaagaggtggaagatatcgcgtcattctatgattaccttgaggttcagccgcctgaagtgtatcgtcacttgctggagcttgaactggtccgtgatgaaaaagcgctgaaagaaattattgcgaatatcacgaagctgggggaaaagcttaataaaccggttgttgctacgggaaatgttcattacttgaatgatgaggataaaatctacagaaagattttaatatcctcacaaggcggggcaaatccgctgaataggcatgaactgccgaaagtgcatttcagaacgacagacgaaatgcttgaagctttttctttcttaggtgaagaaaaagcgaaggagatcgtagtcaccaatacccaaaaggttgcttctttagttgatgacatcaagccgattaaagatgatttatatacgccgaaaatcgaaggcgccgatgaagagatcagagaaatgagctatcagcgtgcaagaagcatttacggggaagagctgcctgaaattgtcgaagcgcggattgaaaaagagttaaagagtattattggccacggatttgctgttatttacttgatctctcacaaacttgtaaaacgttcactagatgacgggtatctcgttggttcccgtggttccgtaggatcttcattagttgcgacacttactgagattactgaggtaaacccgctgccgccgcactatgtttgtcctgagtgtcagcattctgagttctttaatgacggttctgtcggttctggttttgacctgcctgacaagacatgtcctcattgcggaacgcctttgaaaaaagacggccatgatattccatttgaaacgttcttaggatttaaaggggacaaagtacctgatatcgatttgaacttctcaggggaatatcagccgcaagcacacaattacacaaaagtattgttcggagaagacaatgtatatcgtgcgggaacaataggcacggtggcagaaaaaacagcctacggttatgtaaaaggctatgccggagacaacaatcttcatatgcgcggtgccgaaatagatcggctcgtacagggatgcacaggtgtaaaacgtacaactggacaacaccctggcggtattatcgtagttccggattatatggatatttatgatttttcaccgatccagttcccggcagatgccacaggttcagagtggaaaacgactcattttgatttccactccatccatgacaacctgttaaaacttgatattctcggacacgatgacccgactgttattcggatgcttcaagacttaagcggaatagatccgaaaacaattccgacggatgatcctgaagtgatgaagatcttccagggaaccgaatcactcggtgtgactgaagaacagattggctgtaaaacgggcactcttggaattcctgaattcggaacccgatttgtccggcagatgcttgaagatacaaagccgaccactttttctgagctcgttcagatttcaggcttgtctcacggaactgatgtatggcttggcaatgcacaggagctcatccacaataatatttgtgagctgagtgaggttatcggctgccgtgatgacattatggtttatttaatctatcaaggccttgaaccgtcccttgcctttaaaatcatggaattcgtgcgtaaaggaaaaggattaacgcctgaatgggaagaagaaatgaaaaataacaatgtcccagactggtatattgattcctgtaaaaagattaaatacatgttcccgaaagcccacgccgcggcatatgtcttaatggcagtccgcattgcttactttaaagtgcatcatgctcttttgtattatgcggcttattttaccgttcgtgcagatgactttgatatcgatacaatgatcaagggctctacagcaatcagagcggtaatggaggatataaactctaaaggacttgatgcttcaccgaaggaaaagaaccttctgactgttttagaattagcgcttgagatgtgtgagagaggctattcattccaaaaagtcgatttatatcgctccagcgccacagagtttattattgacggcaacagtctaattccgccgtttaactctattccagggttagggacgaacgctgctttgaacattgtaaaagctcgcgaagaaggcgaattcctctcaaaagaagatttgcaaaagagagggaaagtatcaaaaacgattttagagtacttagatcgccacggctgtctggaatcactgcctgatcaaaaccaattgtcactgttctaatatggaatgcagaatttctcagaaattctgcttctatgcatacataagcgcaaaaagtgccatcgtaatattagagtttctgtcacttgcttaggtatgaaggtaagcgtatatccatttgcaataaaaatatggttatggtatagttttattggaaatgctaacgattaccgaggcaaagagtggggaaacccgctcttttgtattgaacaggagaattttgtctcgacatgttcatcgtttactttttagcccctgctcttttgaagcagggtttttatgcagagtgacgagacgaatatgagatcgacagcacaaggaggaagaacatgagcaaaaaagtgactgacaccgttcaagaaatggctcagccaatcgtagacagccttcagctggaactcgttgacattgaatttgtcaaagagggccaaagctggttccttcgcgtgtttattgattccgatgacggtgtggatattgaggaatgtgccaaagtaagcgaagctttaagcgaaaagcttgatgaggcagacccaatcagccaaaattactttcttgaagtctcatctccaggagctgagcgtccgctaaagaaaaaagccgatttcgaaaaatcactaggaaaaaacgtatacattaagacgtatgagcctattgacggcgtaaaagtgtttgaaggtgaactggctgaatttgatggacaaacagtgacagttgagatcacgatcaaaacaagaaagaaacggatcaatattccgtatgaaaagatagctaatgcaagattagctgttacattctaatgaatacaaatgttttaaggggggagaccgttaaatgagcagtgaattattagatgctctcacgattcttgaaaaagaaaaaggcatcagtaaagaaattatcatcgaagcaatcgaagctgcgttaatttctgcttataagcggaattttaatcaagcgcaaaatgtacgggtggatctaaaccgtgaaactggctccatccgtgtatttgcaagaaaagatgtcgttgacgaagtatacgaccagagattagagatctcaattgaagaggcacagggcatccatccggaatatatggtcggcgatgtcgtcgaaatcgaagttacacctaaggatttcgggcgcatagctgctcaaacagcgaagcaggtcgtcacacagcgtgtgcgcgaagctgagcgcggcgtgatctattctgaatttatcgaccgtgaagaagacatcatgacagggatcgtccagcgtctggacaataaatttatctacgtgtctttaggcaaaatagaagccttgctgccggttaatgagcaaatgccgaatgaaagctacaagccccatgaccgcattaaggtatatatcacaaaagtagaaaaaacaacgaagggcccgcagatttatgtgtcaagaacacatccaggcctgttaaagcgtttgtttgaaattgaagtgcctgaaatttatgatggaactgtcgagctaaaatctgttgccagagaagccggcgaccgttcaaaaatttctgttcgcacagatgatcctgacgtggatcctgtcggttcatgcgtagggcctaaaggccagcgtgtgcaagcaatcgtcaatgaattaaaaggtgaaaaaattgatattgtcaactggtccagtgatcctgtagaatttgtcgcgaatgcgctcagcccttccaaagtgcttgatgtcatcgttaatgaagaagaaaaagcgacaactgttattgttcctgattaccagctgtctctggcaattggcaaaagaggacaaaacgcacgcttagctgctaaactgacaggctggaagattgatattaagagcgaaacggacgcaagagaacttggaatctatccgagagaacttgaagaagatgatgagccgctctttacggagcctgaaactgctgaatcggatgaataagaggtgactttaggtgaataaacacaaaaagatcccattacgcaaatgtgtagtgactggtgaaatgaagcctaaaaaggaactgatccgagttgtacggtcgaaagaaggcgaaatctcagtagacccgaccggaaaaaagaatgggcggggtgcttatttaacgctggataaagagtgcatcttagcagcaaaaaagaaaaacactttgcaaaatcaatttcaatcacaaatcgatgaccagattttcgatgaattgctggaactggcggaaaaggtgaaaaaataaaatgtctggaatggaatggtttcccttgctgggtctggccaatcgagctcgtaaggtcgtgtcaggcgaagacttggtaataaaagaaatcaggaatgcgcgtgcaaagcttgtcctgcttacagaggatgcatcatctaacacagcaaaaaaagtaactgacaagtgcaattattataaagtcccttataaaaaagtcgagagtcgcgcggttcttggacgctctatcggtaaagaagcccgtgtcgttgtcgccgtcactgaccaaggttttgcgaataagctgatcagcttgctcgattaatatttttgggggtgaacgaatggctaaaatgagagtatacgaatatgcaaaagcgttaaatgtttcaagtaaggaaattttgaccgcactgaagaacatggatttagaagtgaataatcacatggccatgcttgaagaaaaggccattaaaaagctagatgccaaatataaaaaaggcggcgcagctgctaaatctcaaaagccagcagaaacgaacaaaaacaaacagccacaaggggttaatcagcaatcagctggaaatcaaccaaataaaattcgagacggaaagaagaatgacgtgcagaataatcaatttaacaaaaacaagaagaataacaacaacaaaaaaaataaacgcaacaacaacaataataaaaaccaacatcagcaaaagcctgtaaagccgaaaaaagagcttcctgagaaaattacattctctggcactttaacagttggcgcacttgctgaagagcttggcaaagagccttcagaactcattaaaaagctgatgcttcttggcgtaatggctaccattaaccaagagcttgataaagacacaatcgaactcattgcatcagaatatggtgttgaaacagaagaggtcattgtgcttgaagaaacagagctggaaaaatacgaagagcctgataatgaagaggatcttgaaattcgtcctcctgtcgtgacaatcatgggccacgttgaccatgggaaaacaacgcttcttgacagcatccgtaaaacaaaggttgttgaaggagaagcaggcggaatcactcagcatatcggcgcttatcaaattgaagagaacggcaagaaaatcacgttcttggatacaccgggccacgccgcatttacaacaatgcgtgcacgcggtgcagaagtaactgatattacgattcttgtcgtagctgccgatgacggtgtcatgccgcaaacagttgaagcgattaaccatgcaaaagcagcagaggttccaatcatcgtagctgtgaataaaatagataaagaatccgcaaaccctgaccgtgtgatgcaagaactgacggaatacggtcttgtccctgaagcatggggcggagaaaccatttttgtgccgctttccgctttaactggaaaaggcattgatgagctcgttgaaatgattttgcttgtcagtgaggtagaggaactgaaagcgaatccgaaccgtcaggcaaaaggaacggttattgaagctgaactcgataaaggcagagggtcagttgcgacgttgctcgtacagactggaacactgcatgtcggtgatccgatcgtagtcggcaatacatttggccgtgtccgtgcaatggtcaacgacattggccgccgtgtgaaaactgccggcccgtcaactccggttgaaattaccggtttgaatgatgtccctcaagcgggagaccaattccttgtctttaaggatgaaaaaacagctcgttctgtcggtgaagcccgtgcttcaaaacagcttgaagagcagcgcagcgataaagcgaagctcagtcttgatgatttattcgagcaaattaagcaaggtgatgtaaaagacatcaacctcatcgtaaaagctgacgttcaaggatctgctgaagctttaacggctgcgcttcaaaaaattgaagtagaaggcgttaaagtgaaaatcatccatacaggcgttggtgcgattactgaatctgacattatcttggcatctgcttccaatgcaattgttatcgggtttaatgtgagaccggacggaaatgctaagagtacggctgaagctgaaaatgtagatattcgacttcaccgtatcatttacaaagtaatcgacgagattgaagctgccatgaaaggtatgcttgatcctgaatatgaagaaaaagtaattggtcaagtagaagtacgccaaacattcaaagtatctaaaatcggtacaattgccggcggatatgttactgaaggaaccattacgcgcgacagcggcctccgtttaattcgtgacggcgtcgtcatctttgagggcgaagtagatgttctgaaacgctttaaagacgatgtgaaagaagtttcacaaggctatgaatgtggtattacaattaagaaatacaatgacattcgtgaaggtgacatccttgaagcgtttgtcatgcaagaaattgaaagaacgtgatcggatttgcggagtgtgaatgcatcatttatgatgcaggatcgctaaaagaaaagcgtgccgttctgaagcgggttttaactagggttcaaaacaagttcaatgtttcgatttcggagattggctatcaggacacctggcaaagaaccagcttcggaatcgccgctgtttcttcctctcgcgttcaaacagaaaaagaactgcagcgcgtcctagcgtttatcgattcttttcctgaaattgaacggacgatcactaggacagagtggttttaacttagaggtgattgaattgagtatgagagcaaaccgtgtcggcgagcaaatgaaaaaagaactcggtgatattatcagccgcaagctgaaagacccgagaattggttttctgacagtaacggatgtacgtgtatcaggtgatttgcaaattgcaaaggtgtatatctcggttctcggtgacgagaaaaaacgggaggaagcgctgaaagggctggcaaaagcgaaaggatttatccgatccgaaatcggcagccgcatcagacttcgaaaaacgcctgaaattgaatttgagttcgatgaatcaatcgattacggaaatcggatcgaaacactgattcacgaattacattcagagaaaccatctgaataaaaaaagagaggataggcgtatatcgtctgtcctctttcttcgtttataagaaaaaaactcaaaagaaggagtgaaaggcaaatggttaacggagttctccttttacataaacctgttggcatgacatcgcacgactgtgtcatgaagatccgaaagctgttaaaaacaaaaaaagtaggacatacaggaacgctcgatccggaagtatcaggcgtgcttccgatttgtgtaggaagagcgacaaaaatagtcgaatacttaactgaaaaatctaaaacgtatgatgcagaaataacattgggcttttcaaccacaacagaggatcaaaccggagaaacggtggaaacaaagcctgtcaatcacgacattgataaagcggatgtagaaaaggttttaaacagtttaaaggggaaacaagaacaaattccgcccatgtattccgctgtaaaagtaaacggcaaaaaattatacgaatacgcaagagcagggattgaagtagaacgtccgaaacgtatgataaccattgaagacattgccctgacaacagagattaaacatcatggagaaaccgcaagcttccggtttacagtgacttgctccaaagggacctatgtaaggacgctggcggtcatgatcggagaaaagctcggatatccggcccatatgtctcatttaatccgtacggcatccggagatttttctctcgacgaatgctttacttttgatgaactcgaagcacaggcccaatccggaaccgtggaagagcatacagttcctattgaacgtgcgctcaatcatttgccgaaatggatcataagtgatacattagctaagaaagtagaaaatggggctttgcttgagacgcccgagcagttttctgaaatgacaagtgaagaccgtattgccgtctttactgaatccggaacctgcttggcgatctatttccctcatcctgcaaaaaaagggctgttaaagccggcaaaagtattgatgcaaaaaagcgaacaatagaaaaaaggtgaccgttctgtgaagacgatacatattacacatcctcatcatttaataaaagaggagcaggcaaaatcagtgatggcgttaggttattttgacggcgttcatctcgggcatcaaaaggtaatcggcacagcgaagcaaatagccgaagaaaaaggtctgacattagctgtgatgacctttcatccccatccttctcacgtgttgggcagagataaggaaccaaaggatctgattacgcctcttgaagacaaaataaaccaaattgaacaattaggcacagaagttctgtatgtcgttaaatttaatgaagtgtttgcttctctttctcctaagcagtttatagaccagtatattatcggccttaatgtgcagcacgcagtggcaggctttgactttacgtacggcaaatacggcaagggaacaatgaagaccatgccggatgatttagacggaaaagctgggtgcacaatggtagaaaaattaacggagcaggataaaaaaatcagttcttcgtatatccgtaccgcgcttcaaaacggagatattgaattggcgaatgtcttgcttggacaaccttattttattaaaggaattgtcattcatggtgataaaagagggcggaccatcgggtttccgacagcgaatgtcggtttaaataacagctatatcgttccgcccacaggtgtatatgccgtaaaagcggaagtgaacggcgaagtttacaatggcgtttgcaatattggctataagccaacgttttatgaaaagcgccctgaacagccttccatcgaggtcaatctgtttgatttcgatcaagaggtatatggagccgctataaaaatcgaatggtacaaacggattcggagcgagcggaaattcaatggcatcaaagaattaacagagcaaattgagaaagataagcaggaagccatccgttatttcagcaatttgcggaaataacttgcaacgcacgcaaattttattctaaaatatttgcatataggcacgatttttagtatgatagttttcgtagtcttaaaaccattgcttggcaatccgaagtcaccgacggttgctaggtaactggggctaaatatgatttggaggtgaaacaggatggcaattactcaagagcgtaaaaaccaactcatcaatgagttcaaaacacacgaatctgatactggatctccagaagttcagatcgctatcctaactgactcaattaacaacttgaacgagcatttacgtactcacaagaaagaccaccactcacgtcgcggtcttcttaaaatggtaggtaagcgtcgtaatcttcttacgtatctgcgtaataaagacgtaactcgttaccgtgagttaattaacaaactaggcttacgtcgataatcgtaaaaagcgggaggattcccgcttttttatcgtattaaagcgaaatttcttataacaaatcattgaaatccttttacatactactttgacattgatatgttcaattcatttcgttcataataggagtaattgattatttcacacaacgaagagaggagttcgtaattgtatgggacaagaaaaacatgtctttaccatagattgggccggaagaacgcttaccgttgaaaccggccagcttgccaaacaggcaaatggtgctgtgatgatccgctacggtgatacagcagtacttagtacagcaaccgcttcaaaagaacctaaaccgcttgatttcttccctcttactgtaaactatgaagaaagattatatgcggtagggaaaattccgggcggatttattaaaagagaaggacgtccaagtgaaaaagcggttcttgccagccgtttaattgaccgtccgatccgtcctttgtttgccgatggattccgtaatgaagttcaagtcatcagcattgtcatgagtgttgaccaaaactgctcttcagaaatggctgccatgttcggttcatctcttgcactttctgtatcggatattccgtttgaaggaccgattgcaggggttactgtcggacgcattgatgatcaatttatcattaacccgacagtcgatcagcttgaaaaaagcgatatcaatcttgtcgttgccggcacgaaagatgcgattaacatggtagaagcgggagcggacgaagttcctgaggaaatcatgcttgaggccattatgttcggccatgaagagattaaacgcctgattgcattccaagaagaaattgttgcagcagtcggcaaagagaaatctgaaattaagctctttgaaattgatgaagagcttaatgaaaaagtaaaagctttggcagaagaggatctgctgaaagccatccaagttcatgaaaagcatgcccgtgaagatgccattaacgaagtgaagaacgcagttgtggcaaaattcgaggatgaagaacatgatgaagacacaatcaagcaagtgaagcagattttatccaagcttgtgaaaaatgaagttcgccgcctgattactgaagagaaagtaagaccggacggccgcggtgtcgatcaaatccgtccgctctcttcagaggttggcctcttgccaagaacgcacggttcaggtctatttacaaggggacaaactcaggccctcagcgtatgtacgctaggtgctctgggagatgtgcaaatccttgacggcttaggtgtcgaagagtcgaaacggtttatgcatcattacaacttcccgcaattcagcgttggggaaacaggaccgatgcgcggaccgggacgtcgtgaaatcggacacggagcactgggtgagcgtgcgcttgagccagttattccgtctgaaaaagacttcccttatactgtccgtcttgtttcagaagtgcttgaatcaaacggttctacatctcaagcaagcatttgcgcaagcacacttgcaatgatggatgccggtgtaccgattaaagcgccagttgctggtattgcgatgggtcttgtcaaatcaggcgaacattacactgtcttgactgacatccaaggcatggaagacgcgctcggagatatggactttaaagtagcgggaactgaaaaaggcgtaacggccctgcaaatggacattaaaattgaaggcctttccagagagattcttgaagaagcgcttcagcaggcgaaaaagggcagaatggaaatcctcaacagcatgcttgcaacattaagcgaatcaagaaaagagctttctcgatatgcgcctaagatcttaacaatgaccattaatcctgataaaatccgcgatgtcatcggaccaagcgggaaacaaatcaataagatcatcgaagaaaccggtgttaaaattgatattgagcaggacggcacaatctttatttcctctacagatgaaagcggcaaccaaaaagcgaaaaaaatcatcgaagaccttgtgagagaggttgaagtcggccaactttacctaggtaaagtgaaacggattgaaaaattcggggctttcgttgaaattttcagcggaaaagacggtttggtgcacatttcagagcttgcgcttgaacgcgtagggaaagttgaagatgttgtgaaaatcggagacgagattcttgtcaaagtcactgaaattgataaacaaggacgagtgaatttatcccgcaaagcggtgctccgtgaagagaaagaaaaagaagaacaacaatcttaaatgaaaacataaaaggagcctgggagacccggcttctttattttgaagcttttcaaaagcaggcgggttctaccttgtccctctccttcataatgtgagatgaggggggacagaacatgtacaaaaaatttgtaccgtttgccgtttttttatttcttttttttgtctcatttgagatgatggaaaatccgcatgcacttgattatataggggcaatgaaaaaagatacggtgactgtcacggcgtcaaaagacccgttatatgaagaattgcttcaaaaagcgccggagtacgaagttaagccccagaatgcaagaattgataaagtgtggaaaagcattccaggctacaatggattaaaggtcaatattgaacaatcatataaaaaaatgaaacagcatggtgagtttcgggaaaaagatttggtgtacagtcaagtaaaaccaagtgttcatcttgagtcacttcagcctgagcctatttataaaggaaatcctgacaaaccgatggtggcttttttaatcaatgtggcatggggaaatgagtatttggaaaaaatgcttcctattctgcaaaagcaccaggttaaagctacgttctttttagaaggcaattgggtgagaaacaatgtacagctcgctaagaagattgcaaaagacggacatgaaatcggaaatcattcatacaatcatccggatatgagcaaactgactacaggaagaatttccgagcagctcgacaagactaatgaacaaatagaacaaacgatcggcgttaagccaaagtggttcgctccgccaagcggaagtttcagaaaagcggttatcgacattgcagcagagaaacagatgggaacagtcatgtggacagttgatacaatcgattggcaaaagccggctccgtctgtacttcagacgagagtgttaagcaagatacataatggtgccatgattttaatgcatccgactgaccctacggcggaaagtcttgaagcgctgattacacagataaaagacaaaggatatgcgcttggaacagtcactgaactaatggatgaaacaagactattgaagtaacagatgaaggcagcttgtctttgaataggaggaacaaatttgattaaacgatatacgtgtcaaaatggtgtaagaattgtgctggaaaataacccgacagtccgttctgttgcgatcggcgtatggatcggcacaggttcgagacatgaaacgccggagataaacggaatttctcactttttagagcacatgttctttaaagggacgagcacaaaatctgcacgcgagatagcagaatcttttgatcgtattggcggccaggtcaatgcgtttacttcaaaggaatatacctgctactatgcaaaggtgcttgacgagcatgcgaattacgcgctggacgtattagcagatatgttctttcattcaacgtttgatgaaaacgagctgcaaaaagagaaaaatgtagtatatgaagaaattaaaatgtatgaagatgcgccggacgacattgtacatgatttactgagcaaagccacttacggcaatcattctttaggctacccaattctaggcacggaagaaacgcttgcttcctttaacggtgactctctcagacaatacatgcatgattattatacgccggaccgagtggtgatttcggtagcgggcaatatatctgacagttttatcaaagatgtagaaaaatggttcgggtcatacgaggcgaagggcaaagcgacaggccttgagaagcctgagttccacacggaaaaactgacgagaaaaaaagaaacagagcaggctcatttgtgccttggatttaaaggcttagaggttggccatgaacgtatttatgatttaatcgtcctcaacaatgtgctcggaggcagcatgagcagccggctgttccaagatgtgcgtgaagataaaggacttgcttattctgtttacagctatcacagctcatatgaagacagcggaatgctaacgatttacggcggaacgggtgcaaatcagcttcagcagctgtcggaaacaattcaagaaacccttgccacattaaaacgtgacggcattacctcgaaagaactggaaaacagcaaagagcaaatgaagggaagcttaatgctgagcttagaaagcacaaacagcaaaatgagccgaaacggaaaaaatgaactgctgctcggcaaacataaaacattagatgaaatcatcaatgaattaaacgccgtgaacttagagcgtgttaacggccttgccagacaattgtttactgaagactatgcattagcacttatcagcccttccggcaatatgccgtcttaaaaaggaaagcctgctccataatggagcaggcattttttaatccctttcatcatacatagtacaagggggtgacagacatgcggctcagtgaattatcaggaaaggaaattgtagacatcaaaagagctgaacggctcggagtgctcggccagaccgatttggaaatcaatgaacaggatggacagattacagcactcctcattcccacagttaagtggtttggtttgagaaagcaaggtcatgacattcgtgtcccatggcaccatattcaaaagatcggttcagatatgattatattagatgtacctgaggaaatgcctcctcgacaagagtaaatagcccaattgactgtgaagcgggctctaaagaaaacatctgaaacatcggctgccggagccgatgtttttttatatggaaaaagcgcatcttttatattcaccggtatttccttttgatcataagatgaaggggagcttaacaactagagatccagtatatacaaagaaggtgaacgtttagaatgttaaccggattgaaaattgcagttatcggcggtgacgcaagacagctcgaaattataagaaagctcactgaacagcaggctgacatctatcttgtcggttttgaccaattggatcacggttttaccggggcagtaaaatgcaatattgatgaaattccttttcagcaaatagacagcatcattcttccagtatccgcgacaacaggagaaggtgtcgtatcgactgtattttcgaatgaagaagttgtgttaaaacaggaccatcttgacagaacgcctgcacattgtgtcattttctcaggaatttctaacgcctatttagaaaacattgcagctcaggcaaaaagaaaacttgttaagctgtttgagcgggatgacattgcgatatacaactctattccgacagtagaaggaacgatcatgctggctattcagcacacggattatacgatacacggatcacaggtggccgttctcggtctggggcgcaccgggatgacgattgcccgtacatttgccgcgctcggggcgaatgtaaaagtgggggcaagaagttcagcgcatctggcacgtatcactgaaatggggctcgttccttttcataccgatgagctgaaagagcatgtaaaagatatagatatttgcattaataccataccgagtatgattttaaatcaaacggtactttctagcatgacaccaaaaaccttaatattggatctggcctcacgtcccgggggaacggattttaaatatgccgagaaacaagggattaaagcacttcttgctcccgggcttccagggattgtcgctcctaaaacagctgggcaaatccttgcaaacgtcttgagcaagcttttggctgaaatacaagctgaggaggggaaataaggatgtcgtcattaaaaggaaaaagaatcgggtttgggctgaccgggtcgcattgcacatatgaagcggttttcccgcaaattgaggagttggtcaacgaaggagctgaagtccgtccggttgtcacatttaatgtaaaatctacaaatacccgatttggagagggcgcagaatgggttaaaaaaattgaagacctgactggatatgaggccattgattcgattgtaaaggcagaacctcttgggccgaagctgccccttgactgcatggtcattgcgcctttaacaggcaattcaatgagcaagctggcaaatgccatgacggacagcccggtgctgatggcggcaaaagcgacaatccggaacaatcggcctgtcgttctgggtatctcgacaaatgatgctcttggtttaaacggaacaaatttaatgaggctcatgtcaacaaaaaatatcttttttattccattcgggcaagatgatccatttaaaaaaccgaattcaatggtagccaaaatggatctgcttccgcaaacgattgaaaaggcactcatgcaccagcagcttcagccgattctagttgagaattatcagggaaatgactaaatttacagaaaatctttcccaaactaaaaaattcggtcatagcccgcatattctatggtaaaataaaacgtaaaatcatagtcaaatcaattcaatgaagctgattggcggaaggagttttacagatgggaagaggtttacacgtagctgttgtcggagcgacaggggctgtgggacaacaaatgcttaaaacacttgaagacagaaactttgaaatggacacacttacattgctatcttcaaaacgctctgcggggacaaaagtcacgtttaaaggccaagagctgactgttcaggaagcttctcctgagagctttgaaggggtaaatattgctttgttcagcgccggcggaagcgtatcacaagcattggcaccagaagctgtaaaacgcggcgctattgttatagataatacgagtgcgttccgcatggatgaaaatacaccgcttgttgtgccagaagtgaatgaggcagacttgcatgaacacaacggcattattgccaatccaaactgctctacaatccaaatggttgcggcacttgaaccgatccgcaaagcatatggcttaaacaaggtcatcgtatcaacttaccaggcagtatcaggagcgggtaatgaagctgtaaaagagctttacagccaaacacaggcgattttaaataaagaagaaatagagcctgagatcatgcctgtaaaaggtgacaaaaaacactatcaaatcgccttcaacgcgattccgcaaatcgataaattccaagataacggctatacgtttgaggaaatgaaaatgataaatgaaacgaaaaaaatcatgcacatgcctgaccttcaagtagcggctacatgtgtgagactgccaatccaaactgggcactcagagtccgtctacatcgaaatagaccgtgatgacgctacagttgaagatattaaaaatctattgaaagaagctccgggcgtgacacttcaggatgatccaagccagcagctttatccgatgcctgctgatgctgtcggcaaaaacgatgtgtttgtgggccgcatccgtaaagacttggacagagcaaacggttttcatttatgggttgtttctgataacctattaaaaggcgcggcatggaactctgttcaaattgcagaaagcctgaaaaaactaaacctcgtataaaagagagaattttctaaagacgaatagaagagagtaaggcgctatcagcctgctctcttctgttacgtccgaataatttggagtgaaaacagtgaagataattgttcaaaagttcggcggaacatcagtaaaagatgataaaggccgcaaactggctttagggcatattaaagaagcaatcagtgaaggatataaggttgtcgttgtcgtttcagcgatgggccgaaaaggagacccgtatgcaacagattctttacttgggctgctttacggcgatcagtcagcgatttctcctagggaacaggatttgcttttatcttgcggagagactatttcctctgtcgtctttacaagcatgctgcttgataacggtgtgaaagcagctgcgctgacaggggctcaggctggctttttaacgaatgatcagcataccaatgcgaaaatcattgaaatgaaaccggagcgtttattcagtgtgctcgccaatcatgatgcggtagtcgtcgcaggcttccagggcgcaactgaaaagggtgatacaactacaatcggcagagggggcagcgatacgtctgcagccgcactcggagcagctgttgatgcggaatacatcgatattttcaccgatgtagaaggcgtgatgactgctgacccaagagtggtggaaaatgcaaaaccgcttcctgttgtgacgtatacggaaatctgcaacctggcgtatcagggggccaaggtcattcatccgcgtgctgtggaaatcgcaatgcaggccaaggttccgatccgcgtccgttcgacttattcgaatgataaaggtacattggtgacatcacatcactcttccaaggtcggcagtgatgtttttgaaaggctgattacgggaatcgcccatgtcaaagatgtcacgcagttcaaagtgcctgcgaaaatcggccagtataacgttcagactgaagtgttcaaggctatggcaaacgctggaatcagtgtcgatttctttaacattacacctagtgaaatcgtctatacggtagccggaaataaaacagaaacagctcagcgtattttaatggatatgggctatgatccaatggtgacgagaaactgcgcgaaggtatcggcggtcggcgcgggcattatgggtgttcccggtgttacgtccaaaattgtatcggctctttcagaaaaagaaattccgatccttcagtcggctgacagccatacgacgatatgggtgctcgtccatgaagcggatatggttcctgctgtaaacgctttgcatgaagtgtttgaactttcgaagtaaatgtgattgaatcatgatgaggtgaataaaatgaatttcggaaatgtgtctacagcgatgattacaccctttgacaataaagggaacgtagactttcaaaaactgtctacactgattgattacttgttgaaaaacggaacggattctttagtagtagcgggaacaactggagaatctccgaccctttcaactgaagaaaaaattgcgctttttgaatatacagtaaaagaagtaaacggacgggtgcccgttatcgctggtactggaagcaacaacacgaaagattccattaagctgacaaaaaaagctgaggaagcgggcgtggacgctgttatgcttgttaccccgtattacaataaaccttctcaagaaggaatgtaccagcattttaaagcaattgcggcagagacatctcttccggttatgctctataatgttcctggccgtacggttgcttctcttgctcctgaaacgacgatccgtttggcggcagacattccgaatgtggttgcgattaaagaagcgagcggagacctcgaagcgattacaaaaattattgctgaaacacctgaagacttctatgtctattcaggggatgacgctctgacgcttccaattctttcagttggaggaagaggagttgtgtcagtggcgagccatattgcaggcactgatatgcagcaaatgatcaaaaattatacgaatgggcaaacagctaatgcggcactgattcatcagaaactgctgccgattatgaaggaactgtttaaagcgcctaatcctgctccagtcaaaacagcgcttcagctgagaggtcttgatgtcggttctgtgcgtctgcctctagtcccgttaactgaggatgaacgtctgagcttaagcagcacgatcagcgaactgtaagaaaatttcatacagtgaaacaaacgcggtcattctcacattcagctgagtttgaccgtttcttttacatattggttttccctaaaccttctgctttatcttgttttctaaatttactttcagttataataggaacaagtgatgatggacgggtatgagactaggaggatatagattttgaaaaagaaaaatacagaaaacgttagaattatcgcccttggcggtgtcggagagattgggaagaacctttatgtcattgaaattgactcagacatatttgtcgttgatgccggccttatgcatccagaaaacgaaatgctcggtattgatgtagtgattcctgacatatcatatttgattgaacgggctgaccgcgtcaaggcaatctttttaacgcacgggcacgatgaaaatatcggcggcgttttttacttattaaacaagctgtccgttccagtgtacggaacaaaattgacgcttgcactgttaagagagaaattaaaacaatacggacataaccgaaaaactgatttaagagaaattcactccaaatctgtcattacatttgaatcaacaaaggtatcgttctttagaacgattcacagcattcctgattctgtaggtgtgagctttaaaacatcacttggatctattgtatgcacgggagacttcaaatttgaccaaacacctgcacttaatcagacgtgcgacattggcgagatcgccaagatcggcaatagcggcgtgctcgctctgctttctgacagtgcaaatgcggaacggccgggttacaccccttcggaagcggctgtcagcggagaaatttcggatgcgctgtataattcacagaaccgggtgattattgctgttttcgcatccaatattaaccggattcagcaagtcattcatgcagcggctcaaaatggcagaaagattgccgtagccggaaaaaatcttcaatctgtcctgcagctggcgagaaagttaggatacattgaagcagatgatgaattgtttatttctgtacaggatgtcaaaaaatatccgaagcgcgaagtggccattattacagccggaagccaaggtgaaccattagctgctttgacaagaatggcaaacaaagctcacaaacagctgaacattgaagaaggggatacggtggtcattgcgtcaactccgattcccgggcaggaactcatttactctaaaacagtagatcttcttgcgagagccggtgcacaagtcatctttgcccaaaagcgtgttcatgtatcaggccacggctcacaagaagagttaaagctaatgatcaacctgcttaaaccaaaatatttgattcctgtaaacggcgaatacagaatgcaaaaagctcattcaaaaatcgctgaagaaaccggcatgaagcgcagcgacatcttcttaattgaaaaaggcgacgtcgttgaattccgcggccaaaacgtaaaaattggggataaagttccttacggcaatattttaattgatggtttaggtgtcggtgatatcggcaatatcgtattgagagaccgccgcttgctttcacaggacggaattttaatcgttgtcattacacttgataaacaaaagaaaaatcttgtatcaggaccagaaattatcactcgcggctttgtttatgtaagagagtctgaaggtctaatcgtacaggctactgagctcgtccggtccatcgtgacagaagcgactgaaacatcaaatgtcgaatggtcaacgctgaagcaggcaatgcgggatgctttgaaccaattcctttatgaaaaaacgaaacgtaaaccgatgatcatcccaattattatggaagtataatgactgactaaagaccggagttgctccggtctttattttttgtccttcaagccgggattgaatgaagtatctttgttcataatacaaagagaaactcggaaaggatgaaagcgagatggatcatcgtatggaaaacacagaagaagagcgtcctgaaaaaaatgatgcgaaggacagcattatgaataaaatacagcagcttggtgaaacgacgcttccgcagctgccccaagatacaaatattcattgtctgaccattatcggacaaattgaaggccatgttcagcttcctccgcaaaacaaaacaacaaaatatgaacatgtcatcccgcagattgtggcaattgaacaaaatcccaaaattgaaggcttgctgatcatattaaatactgtcggaggagatgttgaagctggtcttgccatagcggaaatgcttgcatctttatcgaaaccgaccgtttctatcgtgcttggcggggggcattccatcggcgttccgattgctgtatcctgtgattacagctatatcgccgaaacagcaacgatgacgattcatccagttaggctcaccgggctggtcatcggggtgccgcaaacgtttgaatacctggataagatgcaagaaagagttgttaaatttgtgacaagccattccaatataaccgaagagaaatttaaagagctaatgttttcaaaaggaaacttaacacgcgatatcggaacaaatgtagtcggtaaggatgcagttaaatacggattgatcgatcacgcaggcggtgtcggacaggcaatcaataaactgaatgagctcatcgacgaagcaaggaaagaagaaggacggatgattcaatgattctttataccgtgatgccgcaggaaattgtgtttgcagaacagaaccaagagacaagcgcacatgagcaaattgaatataaaggtgtaccgcttctagtcgaaatgaaagggaatgaagcggaagtcattcaaatcatgagcaccaatccaatgcattttctgcatccggacatttcacccggacaaaagctgaaattaaacgtataagaatccaacccttttttaagggcaaaatatgctataataggggaatcctacagaaaaaacgcagcctgtaaacggctgctttcttcattatgtatgaacttacattttttaacgcagtaaggtgatgagtgtggcaaagaaaaaacgaaaatcaagaaaaaaacaggcgaaacagctaaatataaaatacgagctcaacggattgctgtgtatagccatttcaattatcgcaatcttgcagctgggggtagtcgggcaaacgtttatctatttgttccgcttttttgctggagagtggtttattttatgcttgttaggtttattggtgttaggagtctcactgttttggaagaaaaaaaccccaagccttttaacgagacgaaaggccgggttgtactgtatcatcgcaagcatattgctgctttctcacgtgcagctatttaaaaatttgacgcacaaagggtctattgagtctgcaagcgtggtgcgcaatacgtgggaattgtttttaatggacatgaatggcagctctgcttcacctgatttaggcggagggatgatcggtgcgctgctgtttgcggcttcacactttttgtttgcgtcgactggttctcagatcatggcaattgtcatgattttgatcggaatgattttagtaacaggacgctcgctgcaagaaacgctaaaaaagtggatgagcccgattggacgttttataaaagaacaatggttagcatttattgatgatatgaaatccttcaaatcaaatatgcagtcatcgaaaaaaacgaaagcgccgagcaaaaaacaaaaaccggcccgcaaaaaacagcaaatggaaccggagcctcctgatgaagagggggattatgaaacagtatcgcctcttattcattcagagccgattatctcaagcttttctgatcgtaatgaagaggaagagtctccagttatagaaaagcgccccgtacctgtgtcgaagccgcttcaggacatccaaccggagacaggtgatcaggaaactgtttctgctcctcctatgacctttacagagcttgaaaataaggattacgagatgccgtcactggatttgctggcagatccgaagcataccggccagcaggctgataaaaagaatatttatgaaaatgccagaaagcttgaacgcacattccaaagctttggcgtaaaggcgaaagtcacacaggttcatctcggaccggctgtaacaaaatatgaagtatatcctgatgtcggagtgaaggttagcaaaattgtcaatttaagcgatgatttagcgcttgcgcttgctgcgaaggatatcaggatcgaagcgcctataccaggcaaatcagcaatcggaattgaagttccaaacgcagaagtggcaatggtttcgctgaaagaagtgctggagtctaaattgaatgacagaccggatgcgaagctgttaattggactcggccgcaatatttcaggtgaagctgtattggctgagttaaacaagatgccccaccttttggtcgcaggcgcaaccggtagcgggaaaagtgtctgtgtcaacggcattattacaagtattttaatgcgggcgaaaccgcatgaagtgaaaatgatgatgatcgatcctaaaatggtagagctaaatgtctacaacgggattccgcatttgcttgctcctgttgtaaccgatccgaaaaaagcgtcgcaggctttgaaaaaggttgtcaatgaaatggagcggcggtacgaattattttctcatacgggtacaagaaatattgaaggatacaatgattatataaaacgcgccaacaatgaagaaggagcgaaacagccagagctgccttatattgttgtcattgtggacgagctagccgatctcatgatggtcgcttcatctgatgtggaagattcgattacgagattgtcccaaatggcgcgggctgccggcatccatcttattattgcgacacagcggccatcggtggatgttatcacaggggtgatcaaagcgaacattccgtcacgaatcgcgttcagcgtatcttcacagacggattcaaggaccattcttgacatgggtggcgctgagaagcttcttggccgcggcgatatgctgtttttacctgtaggggctaacaaacctgtccgtgtgcagggagcatttttgtcggatgacgaagtggagaaggtcgtcgaccatgtgattacgcagcagaaagcgcaatatcaagaagaaatgattcctgaggagacaacagaaactcattccgaggttactgatgaactttatgatgaagctgttgaattaatcgtcggcatgcagacggcatctgtttcaatgctgcaaagaagattcagaatcggctatacgagagcggcgcgcctgattgacgcaatggaggaacgcggtgttgtcggaccgtatgaaggcagcaaacctagggaagtattattatcaaaagagaaatatgatgagctctcttcttaatgaagggagttccgctctctatagttgtcaataataacattatgtaaactgatcacctttctatttattttttcgacaaaacatgatatagttgtcccaattgttcaataatttttatcgaaagtggtttacggaggggaaacatgtctacaaaagctgataatcggcacttgtatttgaaagtaattgaacgaattaaagaggatataaaaaatgggatctacactgagaaggaaaagctgccttctgaatttgagctttccaaaaagcttggtgtcagcagagcgacgctaagagaagccttgcggatactggaagaagagcatgtgattatcagaaggcatggtgtaggcacttttgtccattctaagccgttatttctttcgggcattgaacagctgaacagtgtaaccaagatgatagaacaggcgaatatgacccctggcacgatttttctatcatcacaagtgcttatgccgtctgaagatgatacgaagagatttcatttggcagaagggcaagaacttttttaccttgaacgagtcaggacagctgacggacagccgattgtgtattgtatagacaaaattccgatgaatattttgccgaattctttttctcatcagcaagaatctatgtttgaccttcttgagaaaaattcaggctccgtaatcagctatgcagtaactgatatagaaccgatcggctatcacgataccatttctccagtgcttgaatgcgatcctgaaacagcccttttgctgttaaaacaaacccattacgatcagcacgataaaccggtgctttattctttaaattattttagagcggataaattcagatttcatgttttgcgtaaacgattctaaaaacggacgcctgtatgtgtctgtttttttatttgcactgattcatgtttctttgtacatactttcattccggttaacgcaatatataagggatgacaagaaagtgaatgggtgaaaatgttgagagagaaaaatggaatgaaaaatattattgcattgtcttctgtcccgcttgtgatgacactcgggaactccatgctgattcctgttcttccgatgatggagaaaaagctgtctgtgacttcatttcaagtatctttaatcattactgtatattcagtagtagcaattatttgcattccgattgccggatatttgtcggatcgtttcgggagaaaaaaaatattgcttccatgcctcctcattgcaggattggggggagccgtagctgcttttgcctcgacctatatgaaaaatccttatgctatgatcttggcggggcgggttcttcaaggcattggttctgcaggtgccgctccgattgtcatgccgtttatcggcgacctgtttaaaggagacgatgaaaaggtcagcgcgggtcttggcgatattgaaaccgccaacacgtcagggaaggtactgagtcccatacttggagccttactggcttcttggtattggtttgtaccgttttggtttattccgtttttctgtttgatcagctttttgctcgtattgtttttggtggccaagcctgaagaagatgaagatgcgcctgctgtttctgagtttattaagagtgtgaagaaaatttttaaacaggatggtcgctggctttatacggtcttcattatcgggtgtgtcattatgtttttgttatttggcgtattattttatttatcagatacgctggagaacaagtatgctattgacggagtagctaaaggcggattactggcaatcccacttttgtttttgtcaaccagttcttttatagctggcaaaaagatcggtaaagataaaggccgaatgaaattttgcgttgttacaggaatgattctgttaaccctttcgtttattgccttgtggtggaaccacagtttttattttttatttgtctttttaagctttggcgggattgggattggaatggctcttcctgctttagatgcattgataaccgaagggattgaaagtgaacaatgcggaaccatttcctccttctacaatagcatgcgctttataggagtagctctcggtccacctgtttttgctgcattaatgtctaatgcaaactggattattttcatactctcggcgttttgcagcatcgtttctttatttttagtgctctttactgtagatgctaaaaaaagtgaagaagaagaaaaaaacttagggacggtctagccagccgtctttttttgcgcttccttgcacagtttacaactgtacctatacagcatgcggaggttattgtttccttataaatcctacagttgctataattacatgaaagagtgtttctgcgaatgctgaaaattggtcataatacatactaattaagaaatgaacgaaggaggttccatatgtcatatgttaatgaactcaaatcaaagcacggcggtttaaccgcacacattgtaaaaacagaaaaattcaaaaccgtctcgcttatttttaagatgcttgcgccgctgacaaaggatcaagtcaccaaaagagcgctgcttccgcatgtgcttcttcgcggaacgaaaagccatccgaaaaccgcagaattgcgttcatacctggatgagctgtacggcacgtcagtatcggctgaccttacgaaaaaaggagagcggcacgtcattacgttcaggcttgaaatcccgaatgaaaaatatttaaaagaccaaacgccgctacttgagaaagggctccagcttcttgcagaaatcgtcttttcacctgctttagagggagacgcttttcagtcacaatatgtggctcaagaaaaacggacgcttaagcaaagaatccaagccgtctatgatgataaaatgcgctattcgaatttaaggctgatacaggaaatgtgcaaaaatgagccttacgcgcttcatgtcaatggtgaaatcgacgatgttgatgacattacggcagagcaattatacgaaacataccaaagcgctatccaaaaagaccagcttgatctatatgttgttggcgatgtggacagtaaccaggtacaatcggcaattgataagtatttcaaaacagaagagcgcactcttggcacgattgaaaacaatcacgctgatgaaaaagttcagccaaaagaagtaattgatgaagaggatgtcaagcaaggaaaactgaatatcggctaccgcaccagcatcacttatacagatcaggattatcctgctttacaagtgtttaacggattgttcggcggattctctcattctaaacttttcattaatgttcgggaaaaagccagtcttgcttactacgcggcttcccgtatagaaagttttaaaggcttgttaatggtgatgtcaggcattgaagtgaaaaattttgaacaggcggtttcgattattgctgagcaattccaggcaatgaaaaatggcgatttcagtgagcaggatatagcacagacaaaggccgtcattcgaaatcaagtgctggaaacgattgatacagcatacggtttatctgaatttttatatcagcaggctgctgctcaagtcgagattcctatcgaagactttcttgccaatattgagaatgtcacaaaagaggatatcattaaagccggcgaaaagattcagcttgatacgacttatttcttaaaagggacggagggtgcatcttgatcaaaccaatcgaatatgaacagcttcaggagacgctgtatcatgaaaaaatgtccaacggccttgatgtttacgttttgccgaaaaaaggcttcaacaagacatatgcggtctttacaacaaagtacggctcgatagataaccggtttgtccctttaggtaaaaacgagatggttcacgtgccggacgggattgctcactttcttgagcacaagctgtttgagaaagcggacggagacgtttttcaagatttcagtaaacagggggcttctgccaatgcgtttacgtcatttacaagaacggcttaccttttctcaagcacatcaaatgttgaacgcaatttagagacgcttatcgattttgtacaggacccatattttactgaaaaaacggttgaaaaggaaaaagggattatcgggcaggagattaatatgtacgacgataaccctgattggaggctttacttcggggtcattgaaaacatgtacaaagagcatcctgtcagaattgacatagcgggaacagtggaaagcatttcacatattacaaaagaccttctttatgaatgctatgaaacgttttatcacccgagtaacatgctccttttcattgtcggccctgtagatcctgaagcgattatttctcaggtaagagaaaaccaggggaaaaagccgtatactgatcagccggagatcaaacggaaagaagtgaaagagcaagaagcggttttccgaaaagaaaaagagatcaaaatgaacgtgcagggaccgaaatgccttgttgggctgaaatccaaaaatccgtttaaattaggcaaagagctcttaaagcatgaactttcaatgaacttattgcttgaagctctttttggcaaaagctctgcccagtatgaatcactttatgaaaaaggatatattgacgaaacgtttagctttgattttactgctgaatatgggttcggttttgcggcgatcggcggagatacgcctgagcctgatcaattagctgaagacatttcaagcatgcttttgcgcgccggtgaactgattactgctgaaaagattgaacttgccagaaagaaaaagatcggcacattcttaaaagcgctgaattcccctgaatacatcgccaatcaatttacccgttatgcgttcttggatatgagcctgtttgacgttgtaacggtactcgagcagattaccctcgaggatgtccagaacgtaatacaagaggaaatcgctgcagacaggctgactgtctgcaaggttgttcctaaatcataaacaaaacatccctccagtgtgaggggtgtttttctgcggaaagaaggaaagagaatgaacaaaacagcactaatcaccggagcaagcggcggcattggcaaaagcatcagcgaaacccttgcggctaaggggtacaatctgctgctgcattacaatacaaatcaaaatgcggcagcggagcttgctgaaaaactaagtcagatgtttggcgtaaatacggagatattacaagctgatctgtccgcgcaagatggagcagataagctgacaagttcaattgttcagccggttgatgcgattgttttaaacagcggacgaagccattttgggctgattacggatgtagataacgcaacggttcaggaaatggttcagcttcatgtagcgagtccgtatatgctgacgagaaaccttctgccaggcatgattcggaataaatcgggagcgattgtggctgtcagctcgatttggggagagactggggcatcctgtgaagtgctgtacagcatggcaaaaggagctcagcattcgtttgtaaaaggattggctaaggagctggcgccaagcggaatcagggtaaacgcagtagcgccgggcgcagttgatacaaatatgatgaatcaatttaccccggctgaaaaagaagagatcgctgatgagattccgatcggccggctggcccggccgcaagaaattgcggatgcaacagcttttctcctgtctgaaaaagcgtcatatatcaccggccaaattctgtcggtgaatggcggctggcactgctgatccgaaaatattcggtgtatagtttcttttgcgaaggacacaataatcttgtaacttcacatgaaatggaggaaacaagcatgtcagtattagaaaactgggatagctggaaaaacttccttggcgaccgtctaaactatgcgcaagataaaggtatgagccaggatacgattacagatcttgcgacagaaatcggcagctacttggctaatgaagtggaatctaagaacgagcaggaaaaagtgctggcagatctttggagtgtagcatcaaaagatgaacagcacgccattgccaatatgatggttaagcttgttgaaaataacagcactcactaggaagagaggggatttttcctctcttttttatgttttcctcatcacagcaacattcttctttctaattagagaaaaatgctttatgataaaggaaggtaaaattttgccacaatgaagggggtatatcatttggcaaagctcgaatggtattttgaatatgaaattcaagtgaaccgccccggactgctcggggatatttcatctcttcttgggatgctttctatcaacatcgtaacgataaacggcgtcgatctttccagaaggggaatgctcctcaggtgccgccatatagatcaaattaaacgattagaatcaatcttaaaaacgatggaaacaattaaagtaacgaagcttagagaaccgaggcttcgcgaccgtcttgccgtacgccacggccgttatattcaacgggatgccgatgacaagaaaacgttccgctttgaacgggacgagcttggcttattagtcgattttatggccgaattgttcaaaaaagaaggccataaattaatcggaatcagaggtatgccgcgtgtggggaaaacggaatcgattgtagcctctagtgtgtgtgcaagcaaaaggtggctgtttgtgtcatcaaccttgctgaagcagacgataagaagccagctgattgccgatgaatacagcactgaaaatgtctttatcgttgacggaattgtgtcaacacgaagaggatcggaacgccatctccagctggtccgagaaatcatgcggctgcctgcaacaaaagtggtggagcatccggacatattcgttcaaaatacagagtatacattagatgactttgattatattattgaactgagaaatgaccctgatgaggttattacatatgaacatgccgaggaaccccaaatgtttgatcaatccgggttttcaagctttgatttttaaaattggaaggtgtttgttgtgactgaactaggaatccggctcaaagaagccagagaggaaaaagcaatgtcattggatgatctccaagcggcaacaaagattcaaaaaaggtatttaaccgccttggaggaaggaaactatgacattattccggggaagttttatgttcgggcattcatcaagcaatatgcagaagccgttgggcttgatgcggatcagctgtttgaggagcataaaaaagatatccctaatacgtatcatgacgatgtgtctgaaaagatctccggcatgaatcttcaaaaggaaatgccaaagccagcatctaaggcgctggagctgctgccaacgatacttgttattctcggcgtgattgttgtgattgccattgtgtacgcgatcattcaatttgccaatcacaaaaacagtgatgatcacaatgcggcatcagaaaaagcaattacgcaaagtgagagcaaatacgaaatccctaaagattcaacgctgaaagagaatcaaaataacagctctgaaaaagagacagacactaaaaaagaaacgaaagaaaacgaagataagaaaaaagaaaatgacagtgagaagctggagattaaagctgctggcactgaaggatcgttaacgacttatgaagtgtccggcgctgataaaatcgagctggaactgaaggcatcagacagctcgtggattcgagtgcgcgatgaaaacagcagctctttaaaagaaggaacgctgaaaaaagacgaaacctataaaaaagacataactgatcagaaacaagttgatatccgcaccggatatgcacctaatctgaaaataaaaatcaacggtaaggttctttcatatgaacttgatccgaaaaaagtgatggcacaaaccataaagattgtaaataaaaaggaagaaaagtcatcttaattatcagatgacttttcttcacgtccgagtatgaaattggaggggctttatgtttaacttaccaaataaaatcacactagctagaatcgcattaatcccaatcttcatgattatcatgctggcgccgtttgactggggcaggctcgaagttggagacgaatcaatcccggtcgcacatttggcgggggccattctatttattattgcatctacaacagactgggtggacgggtattatgcccgaaaattgaatctcgtaacaaacttcgggaaatttcttgatccgcttgcggacaaactgctcgtatccgcagcgttaattatccttgttcaatttgatctcgctccagcttggatggtcattgtgattatcagcagggagtttgccgtgacaggtttaaggcttgttttggccggaacaggagaagtcgtagctgctaacatgcttggtaaaatcaaaacctgggcacagattattgcggtatccgcattgcttcttcataatcttccatttgaacttgtgtcattcccgtttgcggacttggcgctgtgggtagccgtcttctttactgtcgtttcaggctgggaatatttctctaaaaactgggaagcgttaaaaacatctaactaagaaagaaggacttcgtcatggaatttccaaaaaaagcagaaataattgcagtcggttcagagctgctgcttggccaaatcgccaatacaaatgctcaatttatcagcaaacagctcgctgaaatcggggtcaacgtattttatcatacagcggtcggagataacccggagcggctgaagcaggtcatccgcattgctgaagaacgctctgacttcattattttttcaggagggcttggacccacaaaagatgatctgacgaaagaaacgattgcaaatacgctgggacgtccgcttgtgttaaatgatgaggcattccaatccattgaggactatttcaaacgaacaaaacgcacgatgtcacctaataaccgaaaacaggcgcttgtgatcgaaggctctgacgtgctggcgaatcactttggaatggccccgggaatgctcacagagcatgaatcgcgctattatatgcttcttcctggaccgccgagcgaattgcgtccaatgtttgaaaacgaggcaaagcctcttctgctgaaaaagatgggttcaaatgaaaaaattgtgtcaaccgttcttcgctttttcggtatcggtgaatctcagcttgaagccgatttggaagatattattgatgcacaaaccaatccgacaattgcgcctttggcggctgatggagaggtgacgctgcgtctgacagccaaacacgccgatgaaaaggaaacagagcgtctgttaaaagaaacagaggccgttatcttagagcgtgtcggtgaatttttctatggttacgatgatacttctcttgtaaaagagctatctatagcgtgtaaggaaaaaggcataacaatttctgcggcagaaagctttaccggagggctgttttctgaatggctgacggatcatagcggtgcctcaacattatttgccgggggcgttgtttgctatacaaacgacgtgaagcagaatgtgcttggtgtcaagaaggaaacattagatcgttttggggcggtcagcaaggagtgcgcatccgaactggctaagggtgttcaaaaactcactggcagcgatatcggcattagctttactggtgtagcaggacctgatgctcaagaagggcatgagcctgggcatgtgtttatcggcatttccgcaaacggtaaagaagaggttcacgagtttcactttgcgggctccagaacggggatcagaaaacgcggcgctaaatacggctgccatttaatcttaaagcttttagagcaaaaataatattttcagcacattatcctcctaagaaaacatgatttctctgatacattatgatattttgataggaatcacgccaagaaaaaatccgaatatgcgttcgcttttttcttggcaaatcccttcaaacagggtatagtatatgtagtggtaacataaaggaggaaaaaatagaatgagtgatcgtcaggcagccttagatatggctcttaaacaaatagaaaaacagttcggcaaaggttccattatgaaactgggagaaaagacagatacaagaatttctactgtcccaagcggctccctcgctcttgatacagcactgggaattggcggatatcctcgcggacggattattgaagtatacggtcctgaaagctcaggtaaaacaactgtggcgcttcatgcgattgctgaagttcagcagcagggcggacaagccgcgtttatcgatgcggagcatgcgttagatccggtatacgcgcaaaagctcggtgttaacatcgaagagcttttactgtctcagcctgacacaggcgagcaggcgcttgaaattgcggaagcattggttcgaagcggggcagttgacattgtcgttgtcgactctgtagccgctctcgttccgaaagcggaaattgaaggcgacatgggagattcgcatgtcggtttacaagcacgcttaatgtctcaagcgcttcgtaagctttcaggggccattaacaaatcgaagacaatcgcgattttcattaaccaaattcgtgaaaaagtcggtgttatgttcgggaacccggaaacaacacctggcggccgtgcgttgaaattctattcttccgtgcgtcttgaagtgcgccgtgctgaacagctgaaacaaggcaacgacgtaatggggaacaaaacgaaaatcaaagtcgtgaaaaacaaggtggctccgccgttccgtacagccgaggttgacattatgtacggagaaggcatttcaaaagaaggcgaaatcattgatctaggaactgaacttgatatcgtgcaaaaaagcggttcatggtactcttatgaagaagagcgtcttggccaaggccgtgaaaatgcaaaacaattcctgaaagaaaataaagatatcatgctgatgatccaggagcaaattcgcgaacattacggcttggataataacggagtagtgcagcagcaagctgaagagacacaagaagaactcgaatttgaagaataaaaataaaataagtttcaaatgatacaaaaggctgagtgaaaaactcagcttttttgtattttgcaaaaaaatgataaaaatattgctttttttgacaacttttttagggctttattcgtctaacaaaacgtgtgcaaaatggaatttattttgggaggaaaaaatgaatgacaagcccaacccgcagaagaactgcgaaacgcagacggagaaaactaaataaaagaggaaaactgttgcttggtcttttagcagtgatggtttgcattacgatttggaatgctcttcatcgaaatagtgaagaaaacgaaccatctcaagaaactgcagcggtttcaaataccgatcagaaaaaagaggtcaaaaagaaaactgccgaaaaatcagaggaacaaatcaaaacagtggatcgaaaccaaaaaatcagcaattatttaaaagagatcggtttcagcggaacagccatgattgtcagaaatggagaaatcgtaacaaataaaggttttggctatgctgaccgtaaacactacattcaaaataatccattgacatctttttatgtcggttcatcacaaaaagcgctaattgcaactgctattttgcagcttgaggaaaaggggaaacttcagacaagtgatccggtaagtacgtatttacctcattttcctaacggacaaacgattactttgaagaatctgcttacacatacatcggggataaacggacatattgaaggaaacggcgccattactccggacgatttaataaaagatatagaacttcagggaatcaaacgtcagccgggcgtatgggactacaaggattccaactattctgttcttgcttatattattgctgaagtaagcggtgagccctatgaacagtacataaagaatcatatttttaaacctgcgggaatgacgcatgcaggcttttacaaaacatatgaaaaagaaccttatcctgccgtcgggtataagatggagggcagcaaaacagttacaccgtatatacctgatttatcccagctgtatggagcgggtgatatttatatgagcgctatagatatgtacaaatttgaccaagcgctgatagacggaaaactgtattcgcaaaaaagctatgaaaagatgtttacgccagggagcagctccacatacggcatgggattttatgttgctcccggaagctattcaaaccatggtgttatgccgggcttcaatatcttgaacagctttagcaaatctgggcaaaccattgttattttgttctcaaacattcaaaataatgctaaattgggccaagtgaacaataaaatataccagcttctaaatcaagaatgattggcgatcttcttttggatgaattgcattcggcacgtgaaaagaagactggcctgcaaacgttaagatggcaagcttgacaagtatttccgacacatttacaatgaagttgtaacatttgtttttttaacatgattgttaaaccatttaaacttgacaagggcgatgaacacactcattccctgtgaaggttctgtatgttgagaaaactagacaatgtacatgccgacactttttaagcaacaaccaagttcatagcaagaggaggtgaaagtatgaccccaattatgatggttctcatctccattttgctgattctactcggtttagttgttggctactttgttcgtaaaaccattgccgaagcgaaaattgcgggcgcacgcggtgcagccgagcaaattcttgaagatgcgaagcgtgatgctgaagcactgaaaaaagaagctctgcttgaagcaaaggatgaaatccacaaacttcgaatagatgctgaacaggaagttcgtgaaagacgaaatgagcttcaaaaacaagaaaaccgtttactccaaaaggaggaaaaccttgatcgcaaacatgagggaattgataaacgggaagcgatgttggagaagaaagatcattctctgaatgaacgacaacaacatattgaagagatggaaagcaaagtggatgagatgattcgtatgcagcagtctgagttggaacgaatttcgagtctaactcgtgacgaagcgaaacaaatcattcttgagcgggttgaaaacgagctttcacatgacatcgccatcatgacaaaagaaactgaaaaccgtgcgaaagaagaggcggataagaaagcgaaaaacattctttcactcgccttacagcgctgcgcagcggaccacgttgccgaaacaacggtatcagttgtcaatcttccaaatgatgagatgaaaggacgtatcatcggacgggaagggcgtaacattcgtacgcttgaaacgctgacaggaattgacctgattattgatgatacgcctgaagctgtcattctttccggatttgatccgatcagacgtgagacagccagaattgctcttgataaactcgttcaggatggccgtattcatccggcacggattgaagaaatggttgaaaaatctcgccgcgaggtcgatgactatattcgtgagatgggtgagcaaacgacatttgaggttggcgttcatggcctccacccagatctcatcaagatcctcggccgcttaaagttccgtacaagctacggtcaaaatgtgcttaagcattccatggaagtcgcattcttggccggtctaatggcatcggagcttggtgaagacgcaaagcttgctaaacgtgcgggtcttcttcacgacatcgggaaagcaattgaccatgaagtagaaggaagccacgttgagatcggggtagagcttgcgaccaaatataaagagcacccagtcgtgattaacagtattgcatcacaccacggggacgaggagccgacttccattattgctgtactggtagctgcagcagatgcgctttccgctgcaagacctggcgcaagaagtgagacgctcgagaattatattcgaagacttgaaaaactcgaagaaatttctgagtcctacgaaggtgttgaaaaatcatttgccattcaggctggacgcgaagtgcgaattatggtgaagccggattcaattaatgatcttgaggctcatcgactggcgcgagatatccgcaagcgaattgaggacgagctcgattatccaggtcatattaaggtgacagtaatcagagagactcgagccgtagagtatgcaaaataaagtgatgcgctaagcatcactttatttttttgacggcaaggaattttcaagaagaaaggatttacaaaatgagaattttatttatcggagatgttgtcggttcaccgggccgtgacatggtcaaagaatatgtaccaaagctaaaaacaaaatataagcctcactttaccattattaatggtgaaaacgccgcacatggaaaaggcctgacggaaaaaatttatcacagcttaatccagtccggggcagatgcaatcacaatggggaaccacacatgggacaaaaaagaaatatttgattttatagatgacgttccgaacttggttcgcccggcaaactttcctgaaggaacaccggggaaagggatcacatatgtgaaagcaaacggcaaagaactagcagtcattaatttgcagggacgtacgtttttgccgccgcttgatgacccgtttttaaaagcggatgaattgatcgcagaagccgcgaaaagaacaccgtacatttttattgactttcatgccgaagcgacaagtgaaaagctcgcacttggctggtacacggatggacgggcatcggctgtagtaggaactcatacacacgtgcaaacagcggataaccgcattttgccgaagggaacggcatatattactgatgtgggaatgactggcccgtatgacggtatactggggatggacagagagacgattattaagcgattcaaaacgaaccttccagtccggtttactgtcgctgaaggaaaaacaacgctcagcggagttgtcattgacattgacgatcaaacgaaaaaagccgtgaaaattgagcgtattttaatcaacgatgatcacatgttctttgaatagttgaacatatggttattttataaaaatattaaaaagaaaagcaggaatatagcaactccttagtgaatatagtaaaaatggaaggtagcccgctatttttgaaaagcattgtggggatggctttttggatagcaacatctaataatgattgttctaatgaacactcacttatccattgtaaaactaagggggagcagaaatggaaatcttaaaagtttcagcaaaatcgagtccaaattcagtggcaggtgcgcttgcaggcgtgttgagagagcgaggagccgccgagattcaagcgatcggagcgggtgcattaaaccaggctgtaaaagctgtggcgattgccaggggatttgtggcgccaagcggcgttgatttgatttgtattccggcttttacagatattcaaatcgatggggaagaaagaacagcgattaaattaatcgtggagcctcgctaaaaacaaataaagcattctcaacctgtttgcgtaatgcaaacaggttgtttttcatttattgtgatattttctcccgatagtatttttagcacataaatgagcgaatatacaaaatcagaaatgagctaaaacgtttcaaaaaaaatttccgcccatttttcaagacagatacttttgtccttctggaaaagacagtgctgtttacgcttattccatatcatggtacaatccgaatataacaagaatttttcaaggaggattgtacatgcagagtggaaagatgaaagctctaatgaaaaaggacggggcgttcggtgctgtgctgactgaagttcccattcctgagattgataaacatgaagtcctcataaaagtgaaagccgcttccatatgcggcacggatgtccacatttataattgggatcaatgggcacgtcagagaatcaaaacaccctatgttttcggccatgagttcagcggcatcgtagaggacgtgggagagaatgtcagcagtgtaaaagtgggagagtatgtgtctgcggaaacacacattgtttgtggtgaatgtgtcccttgcctaacaggaaaatctcatgtgtgtaccaatactgctataatcggagtggacacggcaggctgttttgcggagtatgtaaaagttccagctgataacatttggagaaatcccgctgatatggacccgtcaattgcttccattcaagagcctttaggaaatgcagttcataccgtacttgagagccagcctgcaggaggaacgactgcagtcattggatgcgggccgattggtcttatggctgttgcggttgcaaaagcagcaggagcttctcaggtgatagcgattgataagaatgaatacaggctgaggcttgcaaaacaaatgggagcgacttgtactgtttctattgaaaaagaagacccgctcaaaattgtaagcgctttaacgagtggggaaggagcagatcttgtttgtgagatgtcgggccatccctcagcgattgcccaaggtcttgcgatggctgcgaatggcggaagatttcatattctcagcttgccggaacatccggtgacaattgatttgacgaataaagtggtatttaaagggcttaccatccaaggagtcacaggaagaaaaatgttttcaacatggcgccaagtgtctcagttgatcagttcaaacgtgatcgatcttgcacctgttattacccatcagtttccgttagaggagtttgaaaaaggtttcgaactgatgagaagcgggcagtgcggaaaagtaattttaattccataaagggggataaacatgacgaaggaatttgagtttttaaaagcagagcttgatagtatgaaagaaaaccatacatggcaagacataaaacagcttgaatctatgcagggcccatctgtcacagtgaatcaccaaaaagtcattcagctatcttctaataattacctcggattcacttcacatcctagactcatcaacgccgcacaggaggccgttcagcagtatggagccggcaccggatcagtgagaacgattgccggtacatttacaatgcatcaagagcttgagaaaaagttggcagcctttaaaaaaacggaggcggcacttgtattccaatcaggcttcacaacaaaccaaggcgtactttcaagtattctatcaaaagaggacattgtcatctcagatgaattgaaccatgcctctattattgacggaattcgactgacaaaggcggataaaaaggtgtatcagcacgtcaatatgagtgatttagagcgggtgctgagaaagtcaatgaattatcggatgcgtctgattgtgacagacggcgtattttccatggatggcaacatagctcctctgcctgatattgtagagctcgctgagaaatatgacgcatttgtgatggtggatgacgcccatgcatccggagtacttggcgaaaacggcaggggaacggtgaatcacttcggtcttgacggcagagtgcatattcaggtcggaacattaagcaaggcaatcggagtgctcggcggctacgctgcaggttcaaaggtgctgatcgattatttgcgccataaaggccgtccatttttattcagcacatctcatccgccggcagtcactgcagcttgtatggaagcgattgatgtcttgcttgaagagccggagcatatggagcgcttgtgggagaatactgcctattttaaagcaatgcttgtgaaaatgggtctgactctcacgaagagtgaaacgccgattcttcctattttaattggtgatgaaggtgtggcaaagcaattttcagatcagctcctttctcgcggtgtttttgcccaaagtatcgttttcccgactgtagcaaagggaaaagccagaattcgcacgattataacagcagagcacaccaaggatgaactggatcaggcgcttgatgtcatcgaaaagacggcaaaggagctccagctattgtaacaagaggaagagtttactcttcctcttttgattccttattgattattattctcaatgagtgtacaatgataggttgccagttgtgcagagcttcaataacctttatactgaagggtggaagtttggtttgaaaggagaaaatatgacatgaatgaaaaacaaaaattagagagcggacaagttaatccatcggacaaaaaatccgagaaggattacagcaagtactttgaagctgtttacattccgccttctttaaaagacgcgaaaaaacgaggcaaggaagccgttacttatcataatgactttaaaatttctgaacaatttaaaggattgggagacggaagaaagttctatatccgtacgtacggctgccaaatgaatgaacacgatacagaggttatggcagggatctttagggcgctcggttacgaagcgacaaactctgttgacgatgccaatgtcattttgttaaatacatgtgcaatccgtgaaaatgctgaaaacaaggtgtttggtgagctcgggcacttaaaagcactgaaaaaaaacaatcccgatctgattttaggcgtgtgcggctgtatgtcccaagaggaatcagtcgtgaaccgtattttgaaaaaacatccgtttgtcgatatgattttcggaacgcataacattcatcgcctgccggagcttttgtcagaagcatacctttcaaaagaaatggttgtagaagtttggtctaaggaaggggacgttattgaaaaccttccgaaagtccgaaatggaaaaattaagggctgggtcaatatcatgtacggctgtgacaaattctgtacgtattgcattgtgccttacacacgcggaaaagaaagaagccgccgccctgaggatatcattcaggaagtgagaaggctcgcaagtgaaggctataaggaaattactctgttaggccaaaacgtaaacgcgtatggaaaagactttgaagatatgacgtacggacttggtgatttgatggatgaactgagaaaaatcgatatcccgagaatccgttttacaacgagtcatccgcgcgactttgacgaccgcctcattgaagtgctggcaaaaggcggaaatctgcttgatcacattcatcttccggttcaatcaggaagctcagaagttctcaagctgatggcccgcaaatatgacagagagcgttacatggagctggtgcgaaaaattaaagaagcaatgccaaacgcttctttgacaacggacattatcgtcggatttccaaatgaaacggacgaacagtttgaagaaacgctttctctataccgtgaagtggagtttgacagcgcctatacgttcatttactctccgcgtgaaggcactccggctgctaagatgaaagataatgtaccgatgcgtgtgaaaaaagaacgcctgcagcgtctaaacgcactggtgaatgaaatttctgctaaaaaaatgaaggaatacgaaggcaaggttgtcgaagtattagttgaaggtgaaagcaaaaataaccctgatattcttgcgggctatactgaaaaaagcaagcttgttaatttcaaagggccgaaggaagccatcggcaaaatcgtccgcgtgaaaatccagcaagcgaaaacatggtcgcttgacggagaaatggtaggagaagcaatcgaggtgaaataagatgacgctctactcaaaaaaagacattgtgcagcaggcacgaaaccttgcaaaaatgatctctgaaacagaagaggttgattttttcaaacgggctgaagcgcaaatcaatgagaatgacaaagtgtccacaatcgttaatcagattaaagccctgcaaaagcaggctgtcaatctgaagcattatgaaaagcatgaagcgctcaaacaagtagaagcaaaaattgacgcgctgcaagaagagcttgaagagattcctgttatccaggaattcagagactcgcaaatggaagtaaatgacctactgcagctcgttgcacacaccatttccaaccaagtcacaaatgaaatcatcacatcaaccggaggcgacctgctgaaaggggaaaccggttcaaaggtgaagcattcaaataacagctgttctctctaaacacggtgcctttacaggcccgtgtttttttatgtgtgggttatgaactaaataatctatgtaccaaatgttcaattggtttttctgtgcgcagccgcgtgtaaactttatcgcacttataagtaaagtttctaggctcacctgcatacaatggaacagaaactttgtatttttatattttatttataaaaatgcacactagacaaatgcccagcataagataacacgaagaagaacaaggaggcatgccggaatgtctgaatacagggaaattattacgaaggcagtagtagcgaaaggccgaaaattcacccaatgcaccaacaccatctcgcctgagaaaaaaccgagcagcattttgggtggttggattattaaccacaagtatgacgctgaaaaaattggaaaaacggtagaaattgaagggtattatgatataaacgtatggtactcttacgcggacaacacaaagacagaggttgtcacagaacgggtaaaatatgtagatgtcattaaactcagatacagagacaataattacttagatgatgagcatgaagtgattgccaaagtgcttcagcagccaaactgccttgaagtgaccatttcgccgaatggaaataaaatcgttgtgcaggcagaaagagaatttttggcggaagtggtaggggaaacaaaggtagttgttgaggtcaatcctgactgggaagaggatgacgaggaagattgggaagatgagcttgatgaagagcttgaagacatcaacccggagtttttagtgggagatcctgaagaataaaaaagggactaggggagacagtacccccaagtctcttttttatattgatatatcattcttttatcactttttgtttatgttataatgaaggttggaaaatagaaacgttgatacatagtgagggattaaacaatggccggttatacgcctatgatacagcaatatttaaaaataaaggcagagcaccaggatgcctttttattttttcgcctgggtgatttttatgaaatgttttttgaggacgccaaaaaagcgtcacaagagctggaaattacgttaacgagcagagatggcggtgcggctgaaaaaataccgatgtgcggtgtgccgtatcattctgcttccgcgtatatcgaacagcttattaaaaaaggatacaaagtggcgatctgtgaacagacggaagatccgaaagccgcaaagggcgttgtgaaaagagaagtggttcagctgattacgcccggaactgtaatggacggcaaaggcatccatgaatcggaaaataattttatcgcatctgtttcagcctgctcgaacggatacggacttgcgctgtctgatttaacaacgggagaaaatttggctgttttgattgaacggcttgaagacgtcatatcagaaatttattcagtcggcgcacgggaaatcgtggtttcaggaagcttggatgccgatacagtggcacagctgagagagcggtgcggtgcaacgatctcaattgaagatggagaaacagacgaacacgtaacgatcattgagcacttaaataatgaagatataacaaaaacatttatgcgcttatatacgtatttgaaaagaacccaaaagcgcagccttgatcatcttcagcccgtgcaggtgtatgagcttgaggaagcgatgaaaattgacttgtactcaaagcgtaatctggagctgaccgaaacgattcgttcgaaaaataaaaaaggctcccttttgtggctgctggatgaaacaaaaacggcaatgggaggccggctgcttaaacagtggattgaccggccgcttatcagagtcaatcaaatcgaagagcgccaagaaatggtggaaacattaatgtcccatttctttgaacgggaagatctgcgtgaacgtttaaaagaagtatatgacttagaacgccttgccggacgcgttgcattcggaaatgtcaatgcccgggatttgattcagctgaaggaatcgttaaagcaagttcctggcatcaaacagctggttgcttcactggctcatgacaaggccaaggaacgtgcagagcgcattgacccttgcggggatgtacttgaactgctggaagaagcgctgtacgaaaaccctcctttatcggtaaaagaagggaatctgattaaagatggttataatcaaaagcttgatgaatatcgtgatgcaagcagaaacggaaaagactggattgcccgcctggaacagcaggagcgggaatacacaggcattcgttctttaaaggttggctttaataaagttttcggttattacattgaagtgacaaaagcaaatttgcacttgcttgaggaagggcgttatgagcggaagcagacgttaaccaatgcagagcgctacattacacctgaattaaaagaaaaagaagcgctcattttagaggcggaaaataacatctgtgaactggagtacgagctgtttaccgagctgcgcgagaaggtgaagcagtatattccgcggctgcagcagcttgcaaaacagatgagcgagctggacgcactgcaatgctttgcgacaatcagtgaaaatcgtcactacacgaaaccggagttctctaaagatgaagtcgaagtgattgaaggcagacacccggttgttgaaaaagtcatggacagccaggaatatgtcccgaacaactgtatgatgggcgataacagacaaatgcttctcattacaggtccaaacatgtcagggaaaagcacgtatatgagacaaatcgcgctcatttccattatggcgcaaatcggctgctttgtacccgcgaaaaaagcggtgcttccgattttcgatcaaatttttacgcgaatcggcgctgcagatgatttgatttccggacaaagtacatttatggtagaaatgcttgaagcgaaaaatgcgattgtcaacgcgacgaaaaacagcctcattctgtttgatgaaatcgggcggggaacgtccacttatgacggcatggcgctggcacaggcgattattgaatatgttcacgatcatatcggcgccaagacgctgttcagcacacactatcacgagctgaccgttcttgaggacaagctgccccagctgaaaaacgttcatgttcgcgctgaagaatataacggaacggttgtctttcttcatcaaattaaagaaggtgccgctgataaaagctatggtatccatgtagctcagcttgccgaactgccgggagatctgattgctcgcgctcaagatattttaaaagagcttgagcattcaggaaacaaaccggaagtgccggtgcagaaacctcaggtgaaagaagagccggcacagctgtccttttttgacgaagcggaaaagccggctgaaacaccaaagctttcaaaaaaagaaaagcaagtgatcgatgccttcaaatcacttaatatactggatatgacaccgcttgaagcgatgaatgaaatgtacaagctgcaaaagaaattacattaaaacggggtgatgaatgtggcaaaagtcatccagctgtcagatgagctttcgaataaaatagcggcgggcgaggttgtggaacggcccgcctcagtcgtcaaagaattggtggaaaatgcgatcgacgctgacagcacagtcattgaaatcgatattgaggaagcaggccttgcatccattcgggtcttggataacggcgaaggaatggagaatgaagattgtaagcgtgctttccgccgccacgcaacgagtaaaataaaagatgaaaatgatttattcagggtgagaacgctcggtttcaggggagaagccctgccgagtatcgcgtcagtctctcatctggagattacaacaagcactggtgaaggagctgggacgaagctcgtcctccaaggaggaaacatcatttccgaatcgcgttcctcaagcaggaagggaactgaaattgtcgtttccaacctgttttttaacacaccggcccgtttgaaatatatgaaaaccgttcatacagagcttggaaacattacagatgtggttaaccgtattgctctggcgcatccagaggtatcgatccgcctgcgccatcatgggaaaaacctgcttcaaacgaacggaaacggagatgtgcgccatgtactggcagcgatttacggcacggctgtcgccaaaaaaatgcttccgctgcatgtgagctccttggattttgaagtaaagggatatatcgccctcccagagattacacgggcgtcgagaaactatatgtcgtctgtggtcaatggccgttacattaaaaatttcccgctcgtcaaagcggttcatgaaggctatcatacgcttctgccgatcggacgccatccgattacttttatagaaattacgatggacccgattttagtcgatgtcaacgtgcatccatcgaagcttgaggtccggctcagcaaggaaacagagcttcatgacttaatacgtgacggaattaaagatgtgtttaaacagcagcagctgattcctagtgcccaggtcccgaaaaaatcagcacctgccatcaaaaatgagcagcagtttataacctttgatgaaaagcctccggaaaaaaaagttccggaaaaatcgactgcgccatcttattcaccgatgaagctcagctcagtcgtaaaagagccggttgatgcggaggaaaaattgccccctctccaatttgatgctcctcctatcgttgatcaggaacaaacccttgaggtgtccgatgtttcagcagaacagcctgaaacatttgagcaggaatgccatgaggaacagccgcagccagcgtctgatcgggttccaattatgtacccgattggccagatgcacgggacttatatattggcacaaaacgaaaacggcctatatattatcgaccagcacgccgcccaagaacgtattaaatatgagtacttccgtgaaaaggtgggggaggttgagcctgaggtgcaggagatgattgtaccgctgacgttccactactccacaaatgaggctttgattattgaacagcacaaacaagagctcgaaagcgtcggtgtctttttagagtcattcggctctaacagttacatcgtccgctgccacccagcctggtttccaaagggagaagaagcagagcttatagaagaaatcattcagcaggtgctcgactccaaaaatatagatattaaaaaactccgcgaggaagcggcgattatgatgagctgcaaaggctccatcaaagcaaatcgccacctcagaaacgacgaaatcaaagcgcttctggacgacctccgaagcacatcagacccatttacatgcccgcacggccgcccgatcatcattcaccactcgacatatgagatggaaaagatgttcaaacgcgtgatgtagcgggggtggtaggcattgatccattctctgaatggatcaatgctttttttgtactccttcgagtgtcagattataagaaacggttgtaaacgtgtgagcagtgttaaagcattatacttcatggtccctccgtataacgaaatttccatttacaggcaattagaattaatgtatattttgggtgagggggtggaaacacatggcatgtggtccgaagatcattatctttttggatgaacttgatgatccgaatgtaagaatcattttagaatgcagaatttaaattacaacattgtgttttgctccctgttcgtgtgaacagggagttttttcgtttatataactggtgatgtccaaatataaggtgttatgaattctccatatctgccatcggcattttaagctgcttctctattaggctggtcatcaaaagcaagttcagtgaaagccatcactgctgatatcacaacaagcaagatatctggaatataaatagactgcataaagtaatctgcaaaacagatcgttataagattgctgataaaatacagtataaaagcaaaaagtgcagtctttttcaatgaaagtgattttgccaaaatgatagagataatctttgtgagtgggtctatgattaaacctacagcaaagcaggctaaaataaataaagctaatgtttgattggaagcgtatgtgatgcccagtatggagaataagcctttcatcccgaagaaaaagccgccgaagatgactgcaagcgcaatggccgcgataaaagtgatagatacaattccgattaattttgatctgaggttaaaatctttagagtgctcgttctgttctttatggttcaagtatgacactcccttcacctgcttactcatacaaacagcacccttgaatcagcccaaaatatctataagtctgttttctgacgaaaatagtatagcatattttaacaaaaccaaaaaaggccctttccactggggaagggcctttttcatcatgttaactcctgagattcgccgaagctttctctttttttggccaaataaaatagctggctgtaatgagaaagtcaattcctataatgacagtccacagtttaagaatgccgctcaacgcctcggttcgggaagagtcattgataaaatagatcatccctgccaatagtcccgcaccaattaagtaggccagcacatgtcttagccagcctttcgcaccgtgtttggcatgatccattccaaaacgtttcagcggttttgcgcctttttttgtcacataatattgaaatttttcatctgcccattgaatcatttgtttcccataagcgatcgatataccgatgtaaacagctgcaatcccatgggctgcggtcgctgaggctccgcggtaaaggtccacaccagttgccgctaacaagatcaaatcgataactggagttaaggcaaggaatagcagtcctaatgtatgtcgtttgaatacgtagcgtacagcaagccccaaaacaatgacaacccaaaacgcaatttcacagaaaacaatcatccatgcgataccgttcaatccattcccctcttttcaatacagttgtattatttaaataatatgttaccatctttgtttttgtaacacaactgtattataaaaattgccctctcatttttttcttgttacaataaagctatgccaaaacaaattgaccatgagaaaagaagaaaacaaattgcagaagcaacgtggcgcgtcattttagaacgagggatggagggagcatcagccagaaatattgcaaaggaagcaggattgtcattaggtgcgctgcgccattatttctctacacaggatgaattgcttgcttttgcaatgaaacttgtccaagaaaaggtgacggaccgaattaaggacattgcagtgagggatttgctccctaaggaaaaagtgttgcaaattttgcttgaaatggtcccgacgaatgaagaaacgattagagagatggaggtttggtttgcttttactgcttacgccagacataaaaaggatatgtttgatgcgaatcatgacgggattttcagcggcatgcggaatctgattgcctatttagatgaatccgatttactgaagccgaatgctgataaagacattgaagctgagagactttacgcgcttgttgacggcttggctttacatgccatgcttgaccctgtgcgagtgaataaagaccgaatcaagcgggtcattatgcagcatgtagagtcaatttgcgtggaagatacacgtgagacacaaaaacgtcatccttaaggcactagtgcgaaaagcgattcttgttgggcatgcgtccaaaagagtcgcttttttatattcaaagaacaaggatctctgaaaaaaatggaaaacgatcatgctgtttggtaaagtggaatgaaagacggactgaggagtgaacactggtccatcgtttaagaactttacatgatagggatggtataaatgaatcttacttacaaagtgcatccaattaaaacaaggtatcagggctggacgaattattgctatatcattgaagatattgtaagcagatctgcaattgttgttgatccctcatgggaattgagtaagataaccactacactttctgaactcgaagcggaattaaaggcagtcgcattgacacactctcattatgatcatgtaaatctggtagacccgctgacgaagatgtttaacgctcaagtttatatgtcaaaaaaagaaattgattattatcaattccgatgcagaaatttaattagcctagatgatcatcagacaatcagcataggaaacacaagagcacaatgtcttctcacaccggggcatacagccggcggaatgtgttatttgttttctgagagtatttttaccggagatacggtgtttacagaagggtgcggcatatgtgaggatgatggcagctctgcggaagagatgtttgatagtattcaaagaataaagtcggaggtttcacctcatgtacgggtgtatcctggtcactcatttggcaaatcgcccggtcattcgataaaggatctttatcagcataatatttactttcaaattgataaaaaagaatattttgtgaaatttcgcactcgtaaaaaccaaaaaggtatttttgattttaaataatccttctgaatctattatcctatttttcttcgaatatctaaatgatttttattttcaaaaatgattacatagaaggtgttatttattttgaaaactcatttgaaagaaaatgaagcgcattatcatgatatggcgccctatacgtgatctgggtcttttttcttatgttctgttatatctcctgatcctttattcctcaatggaaaaaagcagaaaaacaatcgagcaaactgtaggaaaaattaacttgacggataatatttacagaggttaccatcaacatgaacatgctactatttatccggtcatcactattataaaatcatacagaagtgaaatacatctactaatcggaagggtggctttgagagaatgatcacatatgtttttccaggtcagggttcacaaaaacagggaatgggcagcggcctattcgatgaatttaaagaactgacggatcaggcagatgagatcttaggatattctatcaaacgtctttgcctggaaaatccttattccaatttaaacaaaacgcaatttactcagccggcattatatgtggtaaacgcactaagctatctgaaaaaaatcaaggatgaagaagttaaacctgactttgtcgccgggcacagcttgggtgaatacaatgcgttatttgcagctgaagcctttgattttgagacaggtttacagcttgtcagaaaaagaggcgagctgatgagtctgataagcaacggcggtatggcagctgttatgggactaaatgaagagcaggttgcaaaggctctgaaagaatatcatttacatgatgttgatatcgctaatgtgaatgccccatatcaaattgtaatttcaggaaaaaaagatgagattgaaaaagccgcatctctttttgaaacgatgactgaagttacaatggtactccccttaaacgtaagcggcgcgtttcattccagatacatgaataaggcaaaagaagaatttgaggagttccttcatgccttttatttttcgcctccgtctatcccagttatttctaatgtgtatgccaaaccgtatacatacgaattcatgaaacagacgctggctgatcaaattaatcattcagtgaaatggactgacagtataagctacttaatgaaaaaaggccatatggagtttgaggaggtagggcctggaaatgttttaactgggttaattcatcgcataaagaaagatgcggaagcaatgcccagctaaagcatttgcccctatggccgtgcacctcatcaatcaggtctaaacacagatttcctttcatttaaggtataaagttttaaagattcaatcgttcgattgacactgtttctaattgaataactttatatactgttacataaagaggctgataaattaagttagacatttgaactatgtcagccggtctgtcaaaccatcgctcccacatctagatggtccattttttaaccgcacccaccaatcatagagtcgatgttctttgctgatcctgttatcatgttacatcaattttgagatatcaacatacatctacgatcacgtcataaatgaaccgcatccagagcaccaatagcaatccttccaagttgaatctcctttactttttcacatatgtcttttccgtttattaatttcatttcaatcgctgctatgtgctttaacaacatgcatggaaatgagaaatccaatagccgtcataaatataaaaaaagaaggttatacacatgaatgaaccgcttgtttttatgttttccgggcaaggttcccaatactatcacatggggaaagaactatttaaggaaaataccgtgtttcgtcaatcaatgcttgaaatggatgccattgcagcacggcgaatcggcacatccattgttgaagaaatctaccatccaggtaaacgtgtgtcagatccgtttgacagtattcttttttcccaccccgccatttttatgattgagtattccttatataaggttttggaagacaggggaatttatcctgattacgtattgggatcaagtctgggagaattcgcagcagcggcagtttctggtgtgtcagacgcagaggatatactggattgcatacttgaacaggctattatcatccaaaattcctgcgataaaggaaaaatgatggccattctggacaaaccgcaattgctgaatgattatccgcaactgtttggaaatagtgaactcatttctatcaattatgattcgcacttcgtcatttctggtgaagaagatcatataaggaagattatggaggatttaaaggagaagcagattctttgccagctgcttcctgtgtcctatgcctttcattcttcgcttattgatccggcagagagtgcctatgcagaatttttaagatcaaaatcttttcaaaaaccgtcaataccgattgtatcgagcttaacgggaagctgccttcacgtaatggacgagaatttcttttggaatgcggtcagaaagccaatgatgtttcgtgaagcgattcgatatttggaaagccagcatacatgcaagtttatcgatttagggccatccggcaccttagctgcttttgtgaaacagctgattccgggtgatgcagctgaccgttgctgctcaatcataacaccatttcatcaggagctgaaaaatctgaatacggttgagtattaccgtacaccagaaaggaagtttacaagatgattacatatgtctttccagggcaaggctcccagcaaaaggggatgggacaagggctatttgaacagtatcagcatttgacagatcaagcagatcaaatattgggctattcaatagagaagctatgtaccgaaaaatcatatctggatgtaaatcatactgaatacacgcagccggctttgtatgttgttaatgcactcaattacttgaagagagtggaggagaccggcagaaaacctgattttgcggcaggacatagcttaggagaatacaatgcgctgatggcagccggtgcctttgattttgaaaccggattaaggctcgtcaaaaaaagaggagaattgatgggacgaattacagggggcggaatggctgctgtgatcggcctgagtaaggaacaagttacagccgttttagaagagcaccgtcttcatgacattgatgtggcaaatgaaaatacgccccggcaaattgtgatttctggcccgaaaaaagagattgaaaaagctcgggctgtttttgaaagcaccaaggatgtaaagctgtttcatccattaaatgtgagcggagcttttcattccagatatatgaatgaagccaaacaggtatttaagcaatatattgactcattccagtttgcacctttggcgatcccggttatctccaatgtctacgcagagccataccatcaagacagattaaaagatacattatctgaacagatggacaacacagtgaaatggacggacagcattcgtttcctgatgggaagaggagaaatggagtttgaagagattgggcctggaactgttttaaccggtctcattcatcggattaaaaatgaagctgaaccattgacatatataccgaaaaagaaccccgcgatcagtgcgcatctaaaggagaaacgcaatgttcaagctgggattacggcagaatctttaggaagtgctgaatttaaacaagattatcatcttacatatgcttatcttgcaggaggaatgtaccgcggcattgcttcgaaagaaatggtagtaaagctgtcaagagcgggaatgatggggttctttggcacaggaggtctgagcctgaaagaggttgaagatgcgatccatgctatacaaggtgaattagggaaaggacaagcctatggcatcaatctggtccacaatatgaaacatactgaatcagaagaaaaaatgatcgatcttttattgaggaatcaagtgagcattgtggaggcttcagcatttctaagtgtcactcctgcattagtaaggtaccgcgcaaaaggagtgaaacgaaatcaaaatggtgacgttatatgctcaaatcgtctcatagcaaaaatatcacggccggaagttgcagaatcatttctgagtcctgcgcctgagaatatgctgcaaaagcttttaggagaaaataaaatcactatgaacgaagctgagttgttgcggtgcattccgatggctgacgatatttgtgtagaagctgattcaggcggtcatacagatggcggtgtggcatacagcctgatgccggcgatgacatctttaagagatgaaataatgaaaaaatatcaatttcggaaaaaaataagagttggtgcagctggagggattggaacacctgaggcagcgatggcggcttttatgctaggggctgattttattctaacaggctcaatcaatcaatgtacggttgaggcggcaacaagtgataaagtaaaggatttgcttcagcagatgaatgtacaagatacagcctatgcgcctgcaggtgatatgtttgaatcgggcagtaaagtgcaggtgctaaagaaaggcgtgttctttcccgcacgggcaaacaagttatatgaactgtaccagcggtatgggtctatacgtgagctggatgcaaagatgctggcccagcttgaggagaaatactttaaacgcagtatagaagacatatataaagatattgcattgcattatcccgcggcagacattgagaaggctgaacaaaacccgaagcataaaatggctttgattttccgatggtacttcagatacagctcaaaattggcaatcagcggaagcgaacattcgaaggtcgattatcaaattcactgcggtcccgcgctgggagcctttaatcaatgggttaaaggatcgcaattagaaaattggcgaaaccgccatgtggatgaaattgggaaaaaaataatgacagaaacggcagtattgcttcatgaacggatgcaatcgatgtatcagccgtcgcatgaaacagacaacataaaaatgaaagtttgaatattatgaaaaaatacctataaaaatcattaaaataatccctcgaaggagagagcgtattatggataaacagagaatctttgaagtactaatcaccaatatttgcgaggtgcttcctgaattagacggacacagatttgagcctgaagatcagctagttgagctaggagctgactctgtagacagagctgaaattatcacgatggtgctagaggatttatcgctaaaaattcctcgcattgagctatccggggtgaaaaacatcggtgaattagctgaggtgctttatgacaaagtgcaatctgcctgaggtggtggtgaccggtgtaggcgttacggcctccatcggtcaagggaaagaggactttgcttcctcgctgctgtccggcagacatgcctttgatgtcatgaagcgttcaggcagacaaaaagacagccggtttatcggagccgaaattgcgtcattgtcttatcctgaccgactctccaaaaaaatgttgcgaaaagcatcattctccagccgcgctgcattggtaactctcacagaggcttgggaggaggctgaattggacgatgcagattcctcacgtatcgggctggttgttggcgggtcaaattttcaacagagagaaaactttgaagtttatgaaaggtatcaagaccgctccggttttatttctccggcgtatggcctgtctttcatggacagcgatctttgcgggatatgtacagatcagtttggcatcacgggattagcatatacggtgggaggagcctcggccagcggccagttagcagtcattcatgcgattcagcaagtcctgtcaggcgaagttgatacttgcattgcacttggtgctttaatggatctttcttatatggaatgcgaggcgctaagggctttaggcgctatggggacggacaaatatgctgatgaacctgaaaaagcgtgccgtcccttcgatcaaaacagagacgggtttatctatggagaatcgtgcggtgcattggtaatagaacgaaaggagacggctttacgaagaggtcttaaaccttatgcagcattgtctggctggtcaatcaaactggacggaaaccggaatcctgatccttcattagaaggagagattcatgtcatccagcaggcactggagcgtgccaggcttttaccagaagatattgattatattaatcctcatggaacaggctcttttattggagatgaaatagaattaaaggcgctccgtgcatgccggctttcccatgcttatatcaatgcaacaaaatcgataaccggacacgggcttagtgcggcgggcatcgtagagattatttctgttttgctgcaaatgaaaaaatctgccctgcatccgagcaggaatttggatcatccaatcgatgattcctttcattgggtaaatgagaaatcgatttcataccgcatcaaaaatgcgctgagtttaagcatggggtttggcggaatgaacaccgcggtttgtatacaaaacattgagaaatgtggaggcgaatcataaatggtttcagccggaatagaagcgatgaatgtctttggcggaacggcataccttgatgtcatggagctggccaaatacagacacttagatactgcgagatttgaaaacttattaatgaaagaaaaagcggtagcactgccttatgaagatcccgtgaccttcggagtcaatgcagctaagccgattattgatgctttatctgaagcagagaaggaccggattgaattgctgatcacttgctctgaatccgggatcgactttgggaaatcgttaagtacatatatccatgaatatttaggtctcaaccgcaactgccgtttgtttgaggttaaacaggcgtgttattcagggacagcgggatttcagatggcggtgaattttatattatcccaaacttctccgggtgccaaagcactggttatcgccagtgatatttcacgttttttaatcgctgagggcggagacgctttaagcgaagattggtcttatgcggaaccgagcgccggagcgggagcggtggccgttttagttggcgaaaatcccgaggtgtttcaaatagatcccggagcaaatggttattacggctatgaagtgatggacacgtgccgccccattcccgacagtgaagcgggagattctgatctgtctttaatgtcatatttggattgctgcgaacagacctttctggaatatcaaaagcgtgtaccgggtgccaattatcaggacacgtttcaatatcttgcttaccatacgccctttggcgggatggtgaaaggtgcgcaccggacaatgatgcgtaaggtggcgaaggtgaaaacatccgggattgagacggattttttaactcgggtaaaaccaggtttaaactactgtcaacgagttggaaatattatgggggcagccttgtttctggcattggccagcacgatagaccaagggagatttgatacgcctaaacgaattggctgtttttcctacggatccggctgctgttctgaattttacagcggaattacaactccgcaaggccaggagcgtcagcgaacatttggtattgagaagcatttggatcgccggtatcagctctccatggaagagtatgagctattgtttaaggggagcgggatggtgcggtttgggacgcgcaatgtaaagctggactttgagatgataccgggcatcatgcagtccactcaagagaagccgcgcttgtttttagaagaaatttctgagtttcatcggaagtacaggtggatctcgtgacctatcaaacgataaaggtccgctttcaagcgtcggtttgctatattacctttcaccgtcctgaagcgaataatacgattaatgatacgctgatagaagaatgcttgcaagtgttaaaccaatgtgaaacatcaacggtgacggttgtcgttttagaggggcttcccgaggtgttttgtttcggagcggattttcaagaaatctatcaggaaatgaaaaggggcagaaaacaggcaagctcccaagagcctctctatgatttgtggatgaaattgcagaccggcccttatgtcacgatttcgcatgtcaggggaaaagtgaatgccggcggtcttggatttgtatctgccacagatattgccattgctgatcagacggcgtcattcagtctctctgagctgctattcggcctgtaccctgcttgtgttttaccgtttctgatccgccgtatcggccggcagaaagcgcattatatgacgcttatgacaaagccgatttccgttcaggaagccagtgaatgggggttaatagatgcttttgatgctgaaagtgacgtgctgctgagaaagcatttattgcgtttgcggaggctgaataaaaaaggaatcgcacattataaacagtttgtgagctcacttgatcatcaagtcagtcgtgcgaaagccaccgctttaactgcaaatcaagacatgttttctgatcctcaaaaccaaatgggaatcatcaggtatgttgaaacaggacaattcccatgggaggatcagtaaccgtttaaaaatgacaatcagaaccgttaggaggacatcatgacgcattctgttgtagagcttatcgaaattgaatccgccattattcaggtaaagatgcaagatcgcactcataaaaacgcgttttcacaagaacttacagacggtttaattcaagcgtttgaatacatacggcagaaccccaaatacaaagcggtcattttgacaggatatgataattattttgcttcaggaggaacgcaagaaggactgcttcgaattcaacagggattgaccaagttcactgatgacaatctttattctctggcgctggattgtgagattccagttattgcggcaatgcagggccatggaattggaggcggctttgtcatggggctctttgctgacatagtcattctgagcagagaaagcgtgtatacggctaattttatgaaatacggatttacgcctggaatgggcgctacctttatcgttcctaaaaaactgggtttcagcctgtcccaggaaatattattgaatgcgggcagctaccgcggagctgatcttgaaaaaagaggggttccttttaaggtgctgccccgtgcagaagtgttagattatgcagtggagctggcgcaagaactggcggaaaagccgagaaactcactggttacactgaaagatcatttggttgccccgcttcgcgatcagctgccgcgcgtcattgaacaggaattgatgatgcatgagaaaacatttcatcatgaagaagtcaaaagtagaatcaaaggtttatatggtaattaactgaaaatatataaaattttgcaggtgaaatggaggcagcgtgatgagaaataatgataatatccgcattttagctaatccttctgtcagtcatggtgagcctttacatatatctgaaaagcagccggcaacaatacctgaagttttatacagaacggcggcggagcttggggatacaaagggaatcatttatttgcagccggatggaactgaagtttaccaatcatacagacgattatgggatgatggactgcgcattgcaaaagggcttcgccaatcaggcctgaaagcaaaacaaaacgtgattttgcagcttggtgacaattcacagcttctccctgcgttctgggggtgtgtgttaacaggggttgttccggctccattagccgttccgccaacgtatgctgaatcgagcagcggcactcaaaagctgaaagacgcatggacgcttcttgataagccagcggtgattacggaccgggggatgcatcaggaaatgctcgattgggcaaaagaacaagggcttgaagggttcagggcaattattgtagaggatctgctcagcgctgaagcggacacagattggcatcaatccagtcctgaagacttagcgcttttattgctgacttcaggcagtacgggaacgcccaaagcagttatgcttaatcatcgtaacattatgagcatggtgaaagggattattcaaatgcaaggcttcaccagagaggatattacgtttaactggatgccgtttgaccatgtcggagggatcggaatgctgcatttgcgggatgtttatcttggctgtcaggaaattaacgtctcaagcgaaacgatcttaatggagccgttgaaatggctggattggattgatcattaccgagcttctgttacgtgggcgccgaattttgcgtttggtctggttactgattttgcagaagaaataaaagataggaaatgggatctgtcttcaatgcgatacatgctcaatggcggtgaagcaatggtagccaaggtagggcgcagaatacttgagcttttagaaccacatggactgcctgctgacgccatccgacctgcctggggaatgtccgaaacttcatcgggcgttattttttctcatgaatttacccgggctggaacaagtgatgatgatcattttgttgaaataggctctccaatccccggcttctctatgagaattgtgaatgaccataatgaattggttgaagagggtgagatcggccgttttcaagtctcgggtctttctgttactagcggttattaccagcggcctgatttgaatgagagtgtgtttacagaagacggctggtttgaaaccggagatcttggctttttgcgaaacgggcgcttaaccataacaggccgtacgaaagatgcaattatcattaacggcattaattattacagtcatgcaattgagtctgcagttgaagaattatctgaaattgaaacttcttatactgctgcttgcgctgtccgtctgggccagaattcaacagatcagctggctatcttctttgttacttccgcaaaattaaatgatgagcagatgtctcagcttcttagaaacatacaatcccatgtctcacaggtgatcggagtcaccccggaatatttgctgcctgtacaaaaagaagagattccaaaaacggctatcggaaagatccagcgcacccagctaaaaacttcatttgaaaatggagagttcgaccacttgctacataaacccaatcggatgaacgatgcggtccaggatgaggagatacagcaagcagaccatgtgaaaagagtaagggaagaaatacagaagcatctgctcacctgtttgactgaggagctgcatgtttcccgcgattgggtggagccaaatgcaaatatccaaagtcttggtgtgaattctatcaagatgatgaagctcattcgatcgatcgagaaaaactaccatatcaaactaacagccagagagatacatcaatatcctacaattgaacgcttagccagctatctatcagaacatgatgacctcagcagtttgtctgctgacaaaaagggcacggacacatataaaaccgaaccggaaaggagtcaggcaacttttcagcctctctctgaggttcaaaaaggattatggacattgcaaaaaatgtcacccgaaaaaagtgcatatcacgtacctctctgttttaaattttcgtcagggcttcaccatgaaacattccagcaggcttttggccttgtattgaatcagtacccaatcttaaagcacgtcatccaagagaaagatggagtgccatttcttaaaaatgagccggcactttcaattgaaatcaagacagaaaatatctcaagtttgaaagagtctgatattcctgcttttcttagaaagaaagtaaaggaaccgtatgtaaaggaaaacagcccgttagtgcgtgtcatgagcttttccagatctgaacaagagcattttttattagttgtcattcaccatttgatttttgacggagtttcgtctgtcacatttatacgcagtctgtttgatacctatcagcttcttttaaaaggacagcagccggaaaaagctgtttctcctgccatttatcatgattttgcggcatgggagaaaaacatgcttgccggcaaagacggtgtgaagcaccgtacatactggcagaaacagctatcgggaactttgccgaatcttcagctgcctaatgtcagcgcaagttcagtcgattctcagtttagagaggatacatacagcaggcggctgtccagcggcttcatgaatcaggtcagaacgtttgcgaaagagcattctgtaaatgtcacgacggtattcttaagctgctatatgatgctgcttggccgttacaccggccaaaaggaacagatcgtcggcatgccggccatggtgaggccggaagaaagatttgatgatgccattggacattttctcaatatgctcccgattcggagtgagctgaacccggcagacactttttctagctttatttcaaaattgcaattaacgatattagatgggcttgatcatgcagcatatccttttccaaaaatggtgagggatctgaatattcctcgcagtcaagcaggttcaccggtatttcaaaccgcttttttctatcagaattttcttcaatccggaagctatcaaagcttgctgagccgctatgctgacttcttttctgtcgatttcgttgagtatattcaccaagagggcgaatacgaattagtatttgaactgtgggaaacagaagaaaaaatggagctgaacatcaagtacaatactgggctgtttgatgcggcttctatatccgccatgttcgaccattttgtttatgtaacagagcaggcgatgttgaatccatctcagcctttaaaagagtattctttattacctgaggcagagaagcagatgattctcaaaacatggaacgccacaggaaaaacgtatccatatataacttttcatgagttgtttgagcagcaggcgaaaaagacgcctgatagagcggctgtcagctatgaaggtcaaacattgacgtatcgggagcttgatgagaaaagcacacagctggccatttatttgcaggcgcatggagtgggtcctgaccgtctggcggggatctatgtggatcgatcgctggacatgctagtgggtttattagcgatcctcaaggctgggggagcgtatgtgccgctagacccgtcctatccggctgaacgattagaatacatgcttgaggacagtgaagttttcattacactgacgacatcggaattagtaaatacgttgagttggaacggtgtcacaacagctcttttagatcaagattgggatgaaattgctcaaacagcctctgatcgaaaagtgcttacacgcactgtcacgccggagaacttggcatatgtcatttatacatccggcagcacaggaaagccaaaaggtgtcatgataccgcataaagctttgacaaactttctcgtttcgatgggggaaacaccaggtcttacggcagaggataaaatgcttgctgtcacaacctactgttttgatattgcagctctggaattatttttgcctttaataaagggcgcacactgctatatttgtcaaacggagcatacaaaagacgttgaaaaactgaaacgggacatccgcgcgatcaaaccgacagtgatgcaggcaacccccgctacgtggaagatgctcttttattcaggctgggaaaatgaagagagcgtgaaaattttatgcggtggcgaagcatttcctgagacattaaaacgatatttcttagatacgggcagtgaagcctggaatatgttcgggccaaccgaaacaactatctggtcagcggttcagcgcattagcgatgaatgctctcatgccacgataggaaggccaatcgccaatacacaaatctatattacggattctcagctcgcgccagtgccggcaggtgtcccgggtgagctgtgcattgcaggagacggtgtggcgaagggctactacaaaaaggaagaattaacggattcgagattcattgacaacccttttgagcctgggtctaagctttatagaacgggagacatggcccgctggcttccgggagggcgaattgaatatataggccgcatcgataatcaagtaaaaatccgcggattccgtattgaacttggtgatattgaaagcaggcttagtgagcatcccggcattctggaatgcgttgtggtcgcagatatggataacctagctgcctattatacagctaaacatgcaaatgcttctctcacagcgagagagctgcgtcattttgtgaaaaacgctttgcctgcctatatggtgccttcttattttattcagcttgatcatatgccgttaactccgaacggaaagatagatagaaacagccttaagaatatcgatttatcaggggagcagctaaagcaaaggcagacctctcctaagaacattcaggatactgtttttaccatttggcaggaagtgctgaaaacgagtgacattgaatgggatgacggatttttcgatgtgggcggggattcgcttctcgcggtcactgtggctgatcgcatcaaacatgaactatcctgtgagttttctgtcacagacctgtttgagtattcaaccattaaaaatatcagccagtacatcactgaacagcgaatgggcgatgcaagtgaccatatgccgacagacccggcagctcatatagaagatcagtctaccgagatgagtgatctcccagactattatgacgatagtgtagcgattattggcatatcgtgtgaatttccaggggcaaaaaatcatgatgaattttgggagaacctcagagacggcaaggaaagcatagcgtttttcaataaagaagagcttcagcgctttggcatttcaaaggagatagcggagaatgccgactatgtcccggctaaagcttcaattgaggggaaagacagatttgatccaagcttctttcaaatctctcctaaagacgctgaatttatggaccctcagcttcggatgctgctgactcattcatggaaagcaatagaagatgccggttatgctgcgagacagattccgcaaaccagtgtttttatgtcggcaagcaataattcttatcgcgcgctgctgccgtcagatacaacagagagcctagagacgccggacggctatgtttcgtgggtgcttgcacagagtgggacgatcccgacaatgatttctcataagctcgggctgagagggccaagctatttcgttcatgccaactgctcatcatctctgattggattgcattctgcctataaaagcctcctgtcgggtgaatctgattatgctttagttggcggtgcaacgctgcataccgagtcaaatatcggatatgtgcatcagcctgggctgaacttttcgagtgatggacatattaaagcttttgacgcttcagctgacggaatgataggcggtgagggcgttgctgttgtattgctgaaaaaagcagctgatgctgtaaaggacggggatcatatctatgccttgctgagaggcattggtgtaaataacgacggcgctgacaaagtcggcttttatgctccaagcgttaaaggccaggctgacgtggtccaacaggtcatgaatcaaacgaagatacagcctgaatccatctgctatgtagaagcacacgggaccggaacgaagctgggggacccgatcgagctggcggctttaacaaacgtttacaggcaatatacaaataaaacgcaattttgcggcattgggtcggtgaaaaccaatatcggacatttagatacagccgccggtcttgcgggctgcattaaggttgtgatgagtctttatcatcaagagcttgcaccgagtatcaattataaggagccgaatccaaatacagacttagccagctctcctttttacgtcgtcgatcaaaagaaaacgttaagccgtgagatcaaaacgcacagggctgcacttagctcgttcgggcttggcgggacaaatacccatgccatttttgaacaattcaaaagggattcagataagggaaagatagacggaacctgcatcgtcccgatctcggcgaaaaataaagagaggctgcaagagtatgcagaagacattctggcctatttagaaagaagagggcttgagaacagccagctgcctgattttgcgtatacccttcaggtggggcgcgaagcgatggagcatcgcgttgtctttattgccgatcatgtaaatgagttaaaacagaggctcacagattttatcaatggtaaaacagcgattgaaggctgttttcaaggaagtaagcacaatgcaagagaggtttcatggctgacggaggatgaggacagcgctgaactcatacgtaagtggatggccaaaggaaaagtaaacaagcttgcagaaatgtggagcaagggagcgaatatagattggatgcagctttacaagggtgagcgcccaaacagaatgagtctgccgacttatccatttgcaaaggaacgatactggccgtcgcaggatgaccgcaaaccggtggcgcagatatccggaaatcagacagggatcggctctattcatccattgcttcatcagaatacatctgatttttctgaacagaaattcagttcggttttcactggtgacgaatttttcctgagagaccatgtggtaagaggaaagcctgtgcttcctggtgttgcgtaccttgaaatggcgtacgcggctataaaccaggcggcaggaagtgaaattggccaagatgtcagaatcagattgaatcatacagtctgggttcagcctgttgtggttgacagacattcagctcaagtggatatcagtctcttccctgaagaagatggaaaaatcacctttgacatttacagtacacaggaagacggggacgaccctgttattcatagtcaaggcagtgcggagctggcatctgccgccgaaacgccagtcgcagacctcactgaaatgtcacgccgctgcggcaaaggaaagatgtcgcctgatcaattttacgaagaaggcagaagcagaggaatgttccatggtccggcctttcaaggaattaagaatgtgaatataggaaacagagaggttttggcgcagctgcagcttccggaaatcgtttctggaacgaatgaacagtttgtgctgcacccaagtatcatggactccgccttgcagacagcaacaatatgcatcatgcaggaattgacggatcaaaagctgattttgccatttgcgcttgaggagcttgaggtgatcaaagggtgttcttcttctatgtgggcttatgctcgcttaagtgacagcgatcactccggaggggttgttcagaaagcggatatcgatgtcattgacgagagtggaagcgtatgtgtcaggatcaaaggattctcaacgagagtattagaaggggaggttcatacttcaaagccttcaacacggtacgaacgcttaatgcttgaaccggtgtgggaaaaacagaatgaagaacgagaggacgaagatccttcgtacacggagcatatcattgttctcttcgaaactgaacgaagtgtcacagacagcattgcctcccacatgaaagatgtccgtgtgattactctaaacgaagctgaaggacatattgctgaacgttatcaatgttacatgcagaacatttttgaactcctgcaaagcaaggtccgtgaactttctgcaggccgtatcatcattcaagcgattgttccgctggaaaaagagaagcaattgtttgccggcgtttccggtctgtttaaaacagcagaaatagagttcagcaaactgactgctcaggtcatcgaaattgagaaacctgaagagatgatagaccttcacctcaagctgaaagacgacagccagagaccatttgacaaacagattcgatatgaggctggacaccgttttgtgaaaggctggagggaaatggtgcttccttcagctgatatgcttcacatgccgtggagagacgaaggcgtttatctaatcacaggcggagcaggaagcttaggccttctgtttgcaaaggaaattgccaatcgaactggccggtctactattgtgctgacgggacgatctgttttaagtgaggataaggaaaacgagctggaggctcttcgaagcatcggagcggaggttgtctatcgggaggctgatgtaagtgatcagcatgcggttcgtcatcttttggaggaaatcaaagaaagatatggcactctcaatggaattattcacggtgcaggcagcattaaagatcgcttcatcattcataaaacgaatgaagagtttcaagaagtgttgcagccaaaagtgagcgggttgttacatgtagacgaatgcagcaaggatttcccattggactttttcattttcttctcttctctttcgggatgtttaggaaacgctggacaagccgattatgcggcagccaattcgtttatggatgcatttgctgaataccgccgttctcttgcggcatcaaaaaagagattcggctccaccatttccttcaattggccgttatgggaagaaggcggtatgcaagtcggcgctgaagatgaaaagagaatgctgaaaacgacgggaatggtcccgatgccgacagatagtggcttgaaagcattttatcaagggatagtatctgataagccgcaagtttttgtgatggaaggacagcttcagaaaatgaagcaaaaactgctttccgcaggatcgaaagccaagcggaacgatcagagaaaggcggatcaggatcaaggacaaactagaaaattggaagcagccttaatccaaatgattggcgcaattttgaaagtaaacactgacgatatcgatgtcaacacagagctgagtgagtacggattcgactcagttacattcactgtctttacaaacaagatcaacgaaaaatttcagttggagctaacaccgaccattttctttgaatatggtagcgtccaaagcctggctgaatatgtagttgctgcgtatcagggcgaatggaatcaagatgctactgctaaaggcaaagatgaaagaacaaacttagtgcacagtttaagcagcctggaggcatcattaagcaacatggtcagtgcaattttaaaagtaaatagtgaagatattgatgtcaatacagagctgagtgaatacggatttgattccgttacatttacggtctttacaaacaagattaacgaagaatttcagttggagctaacgccgaccattttctttgaatatggaagtatccaaagcctggctgagtatttgactgctgaacatgaggacaccctggttcaggagcgcgaaaaaccagaggggcaggaagagttacagacaaaatcccctgaagcgccgaaaatcacatcacgtagaaagcgccgctttacacagcctgttattgcaaaagcagaaagaaacaaaaagcaggctgccgattttgagccggttgcaatagtcggcatcagcggccgattccctggcgctatggatatagatgaattttgggaaaacctagaagaagggaaagacagcatcacagaagttccaaaagatcgatgggattggcgggagcattatggaaacccagacactgacgtcaataaaaccgacatcaaatggggcggatttattgacggtgtcgctgagtttgatccgttgttttttggtatttcgccgcgagaagctgattatgtagaccctcagcagcgcttgttaatgacatacgtgtggaaggcactggaagatgcgggttgctcgccgcaaagcctttcgggtacagggaccggtatctttatcggtacgggaaacaccggttataaagatctattccatagagcgaatcttccaattgaaggccatgctgctacaggtcatatgattccttcggtaggcccgaatagaatgagttattttttaaatattcatggtccgagcgaaccagtagagacggcctgttccagttctcttgtagccattcaccgtgctgtgactgcgatgcaaaacggtgattgtgagatggcgatcgctggaggcgtgaatacgatcttaaccgaggaggcgcatattagctacagcaaggcgggtatgctcagcaaagacggcaggtgtaaaaccttctccgccgatgcgaatggctatgccagaggcgaaggggtcggaatggtcatgttgaaaaagctggaagatgccgagcgcgacggaaatcatatttatggcgttattcggggcacggcggaaaatcacggcggaagagccaataccctgacatcgcctaatccgaaagcacaagctgatttgttggtgcgtgcatatcgccaagcaggcatagatccaagcactgtcacatatatcgaagcacatggaacagggacggaattgggcgatccgattgaaataaatgggctgaaagccgcgtttaaggaactatccaatatgaaaggcgagagccagccggatgttccggatcaccgttgcggcatcggctcagttaaaagcaatatcggtcatttagagctagcagccggtatttccggtttgatcaaagtgcttttgcaaatgaagcataaaacgttagtgaaaagcctgcattgcgagacgcttaatccttatcttcagctgacagacagtccgttttacatcgttcaggaaaaacaggaatggaagtctgtcacagatcgtgacggaaacgagcttccgcgccgtgccggaatcagttcgtttgggattggcggagtaaacgcgcatattgtggttgaagaatatatgccaaaagccaattcagaacacacggctacaggacagccaaacgtgattgtgctgtcggctaaaaataaaagcaggctgatagatcgtgctttgcaattgcttgaggcgatccgcaataaaaaatatacagatcaggagttgcaccgcatcgcttacaccctgcaggtcgggcgcgaagaaatggatgagcgtctggcgtgtgttgcggggacaatgcaggaacttgaagagaaactgcaggcgtttgttgacggtaaggaagaaacaggcgaatttttccggggacagtctcatcgaaataaagagacccagactatatttacagcagatgaagatatagcgttggcacttgatgcttggatcagaaaaagaaaatacgccaaacttgctgatttatgggtcaaaggggtctcaatccagtggaacacattatacggagagaccaaaccgcgcctgatcagcctcccttcatatccgtttgcgaaggatcactattgggtgccgacaaaggaacattcagaaagagacaaaaaagaactggttaatgcgattgaagatcgggctgcatgctttttgacgaaacaatggagtttgagtccaattggctcagcagtgccggggacaagaactgttgccatcctgagcaatcaagagacagcagatttagcagcagaagtgtcttcgtattttccgaatcatctcttattagatgtgagccggatagaaaatgatcagtcagacattgattggaaagagtttgacggcctagtggatgtcatcggatgcggtaaggatgatgagggccggctggattggattgaatgggtgcaaagactggttgaattcgggcataaagaggggctcaggctgctttgtgtgacgaaggggctcgaatcgtttcaaaacacatctatccggatggctggcgcctcacgggctgggttgtatcgaatgctccaatgcgagtacagccatcttatatcaaggcatatggatgcagaggaggttactgatcatcgccgtctcgcgaagttgatcgctgatgagttttattccgattcttatgatgcggaggtttgctacagggatggtttacggtatcaagcttttctaaaagctcatccggaaacaggtaaggccacggaacagagcgcggtcttcccgaaagatcatgtgcttctcattacaggcggcacacgaggcatcggactattatgcgcccgtcattttgcagagtgctatggagtgaaaaaactggtgctgaccggacgagaacagtttcctccgcgagaggaatggactcgttttgacacctcgaacacatcagttgcccagaaaatccaggcagtgcgggagctggaagcgaagggtgtacaggtggagatgctgccgctgacgttatctgatgatgctcaggttgagcaaacgttgcaacatatcaagcgaacattaggaccgattggcggtgtcattcattgtgcaggtctgacggatatggatacgctggcatttatccgaaaaacttcagatgatattcagcgggtgctggaacctaaggtgtcaggtcttacaacgttatatcgccatgtgtgtaacgagcctttacagttttttgtcttattttcttctgtttcagccattattccggagctttcggcgggacaagctgactatgctatggccaatagctatatggattattttgcagaagcacatcagaaacatgcgccgatcatcagtgttcagtggccgaactggaaagaaaccggtatgggtgaagtgacaaatcaagcgtatcgggaaagcggcttgttgagcattacgaattcagaaggcttacgttttctagatcaaattttatcgaaaatgttcggaccggttgttctccctgcgatggcgaatcaaacaaactgggagccggaactgctgatgaagaggaggaaaccgcatgagggcggtttgcaggaagctgctttacagagcccgccagctagagacattgaagaggccgatgaagtttccaaatgtgatgggttattatctgaaacacagtcctggcttgttgatctgtttaccgaagagctgagaatagatcgtgaagacttcgagattgacggggtgtttcaggattatggcgtggattcgatcattttggcacaagtgctccagcgtataaaccgcaaattagaagcagcactcgatccatcgattctatatgaatacccgacaattcaaaggttcgcagattggctgatcggttcttattccgaaaggctgtccgctttattcggaggcaggatatcggatgcatcagcacctttggagaacataatattggcggaggcagctgttcctgcggaggatcgagctcttacacctcagattcaggcgccagcgattttgtcaccggactctcatgcagaaggtattgccgttgtcggactctcttgccgattccctggggcagatacattggagtcatattggtcgttactatccgaggggcgttcgtcaatcggcccgattccggcagagcgttggggctgtaagacgccatattatgccggcgtgattgatgacgtcagctattttgatcctgatttctttttgcttcatgaagaagacgtaagggcgatggatccgcaagcactgctcgtattggaagagtgtctgaaactcttgtatcacgccggttatacgcctgaggaaataaagggaaagcctgtcggtgtttatatcggaggcagaagccagcacgaacctgatgaagagagccttgatcatgccaagaatccgatcgtgacagtcggccaaaattatttagcggctaatctttcacaattttttgatgtccgcggcccgagtgttgtagttgacaccgcatgctcgtcagctttggtcggcatgaatatggccattcaggcgctgcgtggcggagatattcaatccgccatagtcggcggtgtcagcttgctgagctcagatgcctctcacaggctgtttgaccggcgcggcattttaagcaagcattcatccttccatgtgtttgatgagcgtgctgacggagttgtgttaggtgaaggcgtcggaatggtcatgctaaaaacggtaaaacaggcgctggaagacggagataccatatatgctgttgtgaaagcggcctcggtcaataatgacggaagaacggcggggcctgcaacacctaatctggaggcgcaaaaggaagtcatgaaagatgcgctttccaaaagcggaaaaaaaccagaggacatcagctatcttgaggcaaacgggtcaggttcaatcgtaaccgatctccttgagctaaaagcgatccaatcagtgtaccgttctgggcactcatcgcctctttctcttggctcaatcaagccgaacatcgggcatccgctatgtgctgaagggatcgccagcttcattaaggttgtgctgatgctgaaagagcgccgctttgtcccatttttatcaggtgaaaaagagatggcgcatttcgatcaacagaaagcgaacatcacgttcagccgagccctggaaaaatggacagattcgcagcctactgcggctattaactgctttgccgatggggggacgaatgcccatgtcatcgtagaggcgtgggaaaaagatgaaaaacacgccatcaagcgcagtccaatatcgcctcctcaattaaagaaacgaatgctttcgccaggcgagacaaagctggaagcggagacttcgaaaatgactgcggcaaacatatgggatacttatgaggtggaggtctaacgtgaaaaagataacgaaacaactcacattatcgttaaaaaatccgtttatttatcaccatgtggtttacggacaaaatgtcctgccgggattggcttatatcgatataatctaccagatattcagagaacacggcttctcctgctcagagcttcagctgcggaatttatccatctatcagccattgacggcggaacaggatgcagtaattgttctgaatatccaatgcgcggagaaaaaagaaggacagtggcaaatcacagccaagggaactgaaaaacgtgatgggaaagaagcttcagaagaaaagctctatatgaaggctgatatgtacgcagactccccagccatatttgaagaaacactggatctcagtcaaatcaaagcatctgcacagaacgttgttcagcttgatgatgtatatgaacaatgcagacgtcaggaattggtgcacagcgaatatatgaaagcaaaaggctgcatctatgaagaggaagatggcgtccttcttgagctttctctcggttcggaagccatgcttcacgcagaaggctttatgtttcacccgactctcatagacgggagcggggtgggtgccaatcatttgctcacatctttgcttaaaggagaacagaggctgtatttgcctctgttctatgaatccttttccgcttctgcacttttgcagtcgaattgcatgacgagaattaagcgctcctccgtccggcgggaaaaagagctgatttatgtaacacttgaattttttaatgcgtcgggagaaaaagtggctgagttgaaaaactttacaagcaaattggtgcgagaagcggagctgattagcggaaaacatcaagatgcacaggagacacagatgacaagagcggacactgctgagcgtgataaacctgctgacatggtatcttctcccgttaattcctatagtgaggctgaacagttcgtaagccaattaatcgcagagaaaatcaataagccggtagaacaagttgaaaaacaggtcggttattaccaaatgggactgaattcatcgggcttgcttgaggtggtagaaacgatcagtgataagatcggtgagagcctttcgccgactcttctgtttgagcataccaccatagcggaactgtcagcgtttcttgccgaggaatatgctgagcattttagtgccgctggttcccttggccttggccagaatgaaagagcacgcgtttccgacagcataaacgaccgtaagactgttgaagcttctcgtcctgcacctattgaggcagcaggcgatattgcgattatcggcttggcgggcaggtatccgaaggcagccaatattcatgaattttggaacaatctgaaagaggggaaggactgcgttagcgagattcctgagtcgcgctgggattggcagaaacttgaaggaatcacatctccttcgggtaaggacatttccaaatggggaggatttattgatgatcccgactgctttgatccccaatttttcagaatcacgccaagagaagcggagacaatggaccctcaagagcggctgtttttagaaacatgctgggaaacgattgaggatgcgggctatacgccaaagacgttggccaagcctaaaggacgaaataaaaggcagcatgtaggagtttttgccggtgtcatgcacaaggattatacattagtcggagctgaagaagcatcagcagaaaatgtgtttcctctttcgctcaactatgcgcaaatcgccaaccgtgtttcttacttttgtaatttccacggtccaagtatggctgtcgatacggtatgttcatcctctttgaccgcagtgcacttggcgttggaaagcatacgtcacggtgagtgcgatgttgcgttagcaggcggagtgaacctgtctttgcacccgaataaatatatgacatacggggtctgggatatgttttccactgacggacactgccgtacgtttggaaaggatggagacggttatgtgcctgcagagggtataggcgcggttttattaaagcctttgcgccaggcagaggaagacggagatcgcatttatgcagttattaaaggaagtgctgtgaatcatgtgggcactgtaagcggcatttcagtgccgagccctgtttcccaagctgatctgattgagacatgcttggagaaaacgggaatcgatccgcggacgatcagttatgtggaagcccatggaaccggcacgtccttaggagatccgatcgaaatacagggattagtgaaagcgttccgccaatatacgcaggatcggcagttctgttcaatcggttctgtaaagtcaaacattgggcacgccgaatccgccgcggggatcagcggtttaagcaaggttgctcttcagcttcaccatcaaaaacttgtgccttctttgcattcggaagaactgaatccgtacgttgattttgaaaagtctccattttatgtacagcatgaaacagaaacgtggaagcagcctgttatcaaggagaatggggaagacgtcccttatccgcgacgggcggggatcagttcttttggcgcaacaggttcaaacgcacatattatccttgaggaacatattcctcaagcagcggagcaggacgtttctttgtcctcagattctgacatatccgcagttattccgctttctgcccgtaatcaagaacgtctccgtgtatatgcaaaacgtctcttggattttcttcatgatgggattcagattagagatttggcgtatacattgcaggtaggccgtgaaccgatggaagaacgggtttctttcttagcatccggaattcaagaattgagcgaccaattgaaggcttttatagaaggacgaaaagccattcagcattgctggaagggccgcgtgtcaagaggaagcgaaccatcgcgtcccgccgaatcggtacataaattgctggagcaaagaaaactcgatcagattgcggagcagtgggcgaacggatctggtgttgactggaagctgctttacgagggaagcaaaccaaagcggatcagcctgccgacttacccatttgagagggtgcgttattgggtgccgaaagcggagaaaaagactgatcgttcaaaacaggagcggcacatcctgcatcctcttctgcatcaaaatgtgtccgacatatcgggtgtccgcttccgttcagcgtttacaggacgtgaatttttcttgaaggatcatgtcataaagggcgaacacgttttacctggcgcagctttattggagatggttcgggcagctgtggaaagggcagctgcggatcagttcccgacaggattccggctccggaatatcgtctgggtccggccgttcgccgtcacggaacagcagaaagatatagatgtacgtctatatcctgaggaaaatggtgagattacatttgaaatctgccgggaccctgaaagcgcagaggagtcgccgattgtatatgggcaagggagtgcagtgctttgtgaggctggtgaaaatccggttatcaacattgaagaattgaaggcaagctataatggccggacgctgtcaccttttgattgctacgaggcttatacagaaatgggtattcattatggtgacagccacagagcgatcgacagcctatatgccggcgaaaacggagttctagtgaaattgacgatgcctcctgtaatctctgatacagaagaccattatattctgcatccgagcatgatagattcggcatttcaagcatctatcggtttgaggctgggaggagctacgagtttagaagacagaaaggcaatgctgccttttgccatacaggatgtccaaatcttcaaaggctgcgaggcatctatgtgggcgcggatcacatatagcgagggcagtacagctggggatcgtatgcagaagcttgatatcgatttatgcaatgaagaggggcaggtttgcgtgcgattgacgggctattctgcaagagtgttagaaacaggtcaagaagatccttctgaagcgactgacacgctattgttcgaacatatttgggaagaacgtgctgcagagaggaaagagctcatagagtacgacacacataaagtcgttatctgtgatgttggagaacaaatggaaagcctccaaaatcatcttgactgtacagttctgcagcatgatacagagacaattgatgaacggtttgaaggttatgccatacagttatttgaagaaatcaaacagctaatgcactcaaaaacagggggacatacattcattcaagtggcggtgcctgcgttggacgagcctcagctattaagcggcttaactggattgctcaaaacggctgaactggaaaatccaaaactgacaggacagttgatcgaaatagagaccgggatgtcagctggtgacctattcgaaatattggaggaaaacagacgctatccgcgtgacacgcatatccgtcactggcaagggaagcgatttgtaagcaagtggaaagaagtgtctggtgagcacctaagagctgatatgccatggaaggataaaggcgtgtatctgatcacaggcggtgcaggcggtcttggattcatctttgcaactgaaattgcgaaccaaacgaatgacgcggttgtgatcctgacaggacgctctccgcttgatgaaaggaagaagaagaagcttcaagccttacagaaacttggcatccaagcgatttacagacaagctgatctggctgacaaacaagcggttgatgccttattaaaagaaacccaaaacgtttacggagacttagatggcatcattcatagcgccggtttaataaaagataatttcattatgaagaaaaagaaagaagaggttcaaaccgttcttgctccaaaggtcacaggactggttcaccttgacgaagcaacgaaagatattccgctcgatttctttatccttttttcctcaggtgccggagcagtaggaagcgcgggacaggctgattacgcaatggccaatgcatttatgaatgcatttagcgaatatcgtaatggccaagcagagctgcacaagcgttacggaaaaactctttcagtgtgctggccgctgtggaaagacgggggcatgcaaattgatgcggaaactgcaaggatgctgaaaagagaaacaggcatggtggccatggaaacagatcgtgggattcaggcgctatatcatggctggacgtcagggaacccgcaagtgttagttgcttccggtgttactgatcggattcgtgcatttttacatgaaacgggacatggcaaaggccaatctcacaatatcaaaaaaagcagtctcaatcaggaggcagaaaaagcagacatcattggggaaattgatgaagagatactaagagaaaaagcggagaactattttaaacaggtgctttcttcggtgattaagctgccagctggccagattgatgctgaagctcctctcgaggattacgggatcgattctatcatgatcatgcatgtaacgggtcaattagaaaaagtattcggatctttgtccaagacgctgttctttgaataccaggatattcggtcattaacccggtattttattgattcccgcagagaaaaactgctggacatcttgggatttgaaacgggaaaaccttctgttgaaagaaaatcagaacctgaaaaacaagaaatcccagttatcccaagaaagtctggatttcttcctttgcaagataaagagcagaagcaggtaagagagaaggaaacggaagaaattgcgatcatcggtatctcaggtcgctatccgcaggcagacaacattgatgaattatgggaaaacctgagggacgggcgagactgtattacggaaattcctgcagaccgctgggatcacagtctttattatgacgaagataaagacaagcctggaaaaacctacagcaagtggggcggcttcatgaaggatgtagacaagtttgacccgcagtttttccatatttcgccgcgtgaggcaaaattaatggacccgcaagagcgtttatttttgcagtgcgtgtatgaaacgatggaagacgcaggctatacaagggagcatctcggccgtaagcgtgattcggagcttggcggaagcgtcggtgtttacgtcggtgtcatgtacgaagaatatcagctgtacggggcacaagagcaggtgcggggaaggtctctggctttaacgggaaatccatcatccatcgcgaaccgagtatcttattattttgattttcacggaccgagtattgctttagacaccatgtgttcttcttctttaacggctatccacttggcctgccaaagcctgcagcgcggagagtgtgaggcggcattcgcgggcggcgtgaatgtgtcaatccatccaaataaatatttgatgctcgggcagaacaaatttatgtccagcaaaggccgatgtgaaagcttcggacagggcggagacggctatgtgccgggggaaggcgttggagcagtgcttctgaagccattgtctaaagcagttgaagatggtgatcacatttatggaatcattaaggggacagccattaaccacgggggaaaaacaaacgggtactcagttcccaatccgaatgcccaagcagatgtcatcaaaaaggcgtttgtggaagcgaaggttgacccgtgggcagtcagttacatcgaagcccacggcacgggaacctctctcggtgatcctattgaaatcacagggctgtccaaagtgtttacgcaagaaaccgatgacaaacaattttgtgcaatagggtcagccaaatcaaatatcgggcactgtgagagtgcggcaggtatcgcaggagtaacgaaggtattgctccaaatgaaatacaggcagcttgcgccttccctgcattcaaacgtgctgaacccgaatattgatttccttaactcgccgtttaaagtacagcaagagctagaagagtggaagaggccgatcatcagtgtcaatggcaaagacatcgaattaccgagaatcgcaggagtctcttcatttggtgccgggggtgtgaacgcccatattttaatagaagagtatgattcggaacctgtggaggagcgtttaccagcgaggaaacagccggctgtcattgtgctctcagcaaaaaatgaggaaagacttcagaaacgcgcggagcgattgctgcataccattcgtgaacaaacatatgttgaagcagatttacaccgaattgcctatacgcttcaagtcggacgggaagcgatgaacgaacggctggcgttcgttgcggaatcgatgcgggagcttgaagaaaagctgaatgaatgtatctccggaacagaaaatcgtgaatatgtctatcgcggacaagtaaagcgcaacaaagaagccattgctgcttttgctgctgatgaggatatgtcaaaaacaattgaggcatggctgcaaaaaggcaaatatgcgaaggttttagacctatgggtaagaggtttgcgcatcgactggagcacgctatatcaggatcaaaaaccgcagcgcatcagtttacctgtctatcctttcgcaagagatcgctattggatagacgtacatgcaatggctgaggaaaaaagaacggaggagccattcgctccggtacagcccgtccttccaaagccgtctgtagccagagaagccagcggcaagcctgccaatattacgttacagcctttaatgaccaatcaggatcgtttagagcgttttccatcagatacagaaacagagacgatcacggcggaagccttgtgcgatgaactgacagcgggcttagcggaagtgctgtacatggaccaaaacgagattgatccagacgaagctttcatagatatcggtatggactcgattaccgggctcgaatggataaaagcaataaataaacagtatggcacatcactaaatgtcacaaaggtatatgattatccgacaacacgtgatttcgctgtttacttagcacacgagttaagcacacaggctggggagaaaaaacaaacggagacgtacacgccgatcagacaaaaaacagcggtacctgctgctaaaccggctaatatatctctgcagccgttagaacatcatcagccagtgcaagaggagggtgaagaaacgattcaatatgcagcggcagaaatatctgcatcaagacaatatactgtagcaattgaaacgctgcatgaaaacttgagggaaagcatagcagacgtgttatacatggagccatacgaggtggatattgacgaagcgttcatagatatcggaatggactcgattaccggactcgaatggataaaagcggtgaacaagcaatacggaacgtcttttacggtaaccagggtatatgattatccaacgatacgtgattttgccgaaatgctaaagtccgagcttggaactcatcatgatagagaggtagagcatactgttcctatcgaagcagtccagcaaaagccagcagcaccatctaatccaaagccggcagaacggccccttcagcctgttcaacatccaataaagaaagaacatgagaagaaaacggtacctgttcatcaagactacccggaggatgcgatagcgattgtcgggatgtcgggaagatacccgggcgctcgtaatgtaagagagtactgggataacctggttcatgcgagaaatgctattcgggacattccaacatcacggtgggatgttgacaaatactatgatcctgtcctcaacaaaaaaggaaaagtctattgcaaatcaatggggatgcttgatgatattgaacattttgatccgttgttttttaatattccgccgtcagaagctgaactgatggacccgcagcatcgaatctttttgcaggaaggctataaagcctttgaggacgctgggtacaacgcccgaactttaaatgagaaaaaatgcggtgtatatctcggcattatgagcaatgaatacggggtcatgctgaaccggcaggcaagagcaaatgccaccgggaacagctttgcgatcgctgcggcgcgtattccatattttcttaatttaaaagggcctgcgattcctattgacaccgcttgttcatcttcattggtcggcacacatttagcgcggcaggcacttataaacaaagaaattgatatggcgctggtcggcggggtcagcttatacctgacgccggaatcttacatcagtatgtgtgaggccggcatgctttcacctgatggacaatgtaaagcatttgacaatggcgcgaatggttttgtgcccggcgagggtgcgggtgcgctggttctgaaaaggctgaaagatgcagaagcggaccgtgaccatatttatggcatcatcattggctcgggtattaatcaggacgggaaaacaaacggaatcacggcaccgagtgcaaaaagccaaatggacctggaaagagacatatatgaaacatacggcatacatcctgagagtatcagttatgtcgagatgcatggcacaggaacaaaacaaggcgatccaattgaattagaagctctgtccaccgtatttcaagaaaaaacagacaaaaagcagttttgcgcaatcggttccgtcaaaagcaatattggccatacatccgcggcggcaggagtagccggggttcaaaaagtgttattatgtatgaatcataaaacacttgtgccgacattgaacttcacgacaccgaatgagcattttgaatttgagcattctcctttatacgtaaatacggagcttaagccttgggaaacgggtgatggaaaaccgcggagagcatgtgtgagctctttcggatatagcggaacgaatgcccatatcgtgatagaggaatatcagcctgaaaagaggagcgatccattaacaaagcagcaccgctcagcattatttgtactttcagcgaaaaaagagaagcaattgaaggcctatgcggaagcaatgaaagatttcgtaacttccaatgaagatatcgatctggaggatatggcatacacacttcagacgggccgggaagcaatggattatcgcatggcgtttttggcggattcgagagaaatgctgatcaaagctttagatgattatttggctgaaatgccgaacggcagcatatttgctgctcacgtgaaaacgaagaagagcgaaatcaagctgtttgaaacggatcatgatgccaaagcattgctgcaaacatggatagagaaaaaaaggctggagaaagtagcagagctatgggtgaaagggctgcagatagattggaacaagctttatggggaatacacgcctcgccgaatcagcctgcctgcttatccgttcgcggaagagtattactggctgccaactcaagaaggcgaacccgaaaccattgctacagcaatgcctcaattcgaactgatgccaaagcgctgctttctgcgtaaacagtggcagccttgtccgattgaaccggcagaaatgacgaatcaaaccgtcgccattttggcaaatgaggagacaatggcattagcggaagagctttcgacgtatttctcgacataccgtatatttgacagccaagagctggatcgggtatctgctgctgactatgaacacgttgctggagcaatcgatctgatcgggtgcggaacgagccatgagcattctatgggctggataaactggctccaaaagctgatcgagcaaggacgtgcaagcaagcatcatttgacggtcttgggtgtaacaaaggggctggaggcctacgcaaatgagggtgttattttgtctggtgcttcacgggccggtttataccgcatgcttcaaagtgagtacagccatcttacttcaagacatgcagatatggaatgcgaagcctctcatgaggagctggccagactgattgcagttgaatattatgccaagagcacagaatcagaagtctgttatcgaaacggacagcgatatcgcgcatatttgacagagcagccagcagaagccgctctaagtcataagcaagtatcgttttcaacagacaaagtcctgctcattacaggcgggacaagaggtctcggcttgctgtgtgcgcggcattttgtgaaaacatacggcgttaagcggctggtccttatcggccgtgaagagcttccaccgcgtgaccagtggaatttggtaaaaatttcctcgcttgccgagaaaataaaagccgttcaagagctagaagacatgggtgcgcaagttcaggtgctgtctctggatctcacagacagggttgctgtcgaacagagcctgaagacaatacacgaaacaatgggggcgattggcggagtcatccattgtgccgggatggtgaacaaacaaaacccggcttttatcagaaaatcactagaagagatcggacaggtttttgaaccgaaagtcgaaggtctgcaaacgttgtttgacctgcttcaagatgaaccattggcgtttttcaccttgttttcatcagtatcagcggccatccctgcactagcagcaggacaagctgattacgcgatggcaaatgcttttatggattattttgcggaggctcatcaagataaatgtcccattgtaagcattcagtggcctaactggaaggagaccggtttaggcgaggttcgaagcaaagctttagaacaaactggattgatcagtttgacaaacgacgagggattacagctgcttgaccagattctatcagacagacagtatgctgtcgtgctgccggcagtaccagatacaaacgtttggaagccggataagctgatgcagccgtcattgcctgtcgaagctctctcgcatcctgagacgaaagagcaaaccggcactcgcaacctgttccctgaaacagtcgactggctcgtaactcttttttcagatgaactgaaaatagctgcagaagactttgaaacggatgaacctttccaagaatacggaatcgactcgattatattggcccagctggtacagcagatgaaccaacaattaaatggagatattgatccgtcaatcttgtttgaatacccgacaatagaatcctttgcacactggctcatttcgaaatatgacatatcagctgttttacagccatctgttcctgagaaacagacacctctcaagccgcaatcagcaatgaaacagaagctggtgccagaacagcggccgcaacagataagccatgaaaaaacggcacttcttgctgaggacatcgctatcatcggtcttagttgcaggttcccgggagcggaaaccctagaggaatactgggatttaatacgtgatggacggtctgcgattgcgcctgttccgcctgaacgattcgggaactccagctcgaattacgcgggcctcattgatgaaatgaaccgatttgatcatgatttcttcatgatgtccgaaagcgatgtcagagcgatggaccctcaagctttggctgtattggaggaaagcttgaagctatggtatcacgcgggttatacagagaaagaagtgaaaggcatgagggctggtgtttatataggaggccgcagccagcacaagcctgatccggccagtctttcaaaagcaaaaaatccgatagtcgctggtggacaaaactatttagcggctaacatctcacaattttttgacttgaagggaccgagtattgtcctggataccgcttgttcctctgcactggtggggctgaatatggccattcaggctctgcgaagcggagatattgaggcagcggttgtaggcggcgtcagtttgcttgatgctgatgcgcatcgaatgtttcatgagcgcggacttttatgtgacaaaccgtcattccatatttttgataagcgggcagacggtgtcattttaggagaaggcgtgggcatggttctcgtcaaaaccgtcagccaagcggttgaagacggagattccatatatgcagtcattaaagccgctgcgattaataatgacggaagaacggcaggcccatcatctccgaatctcgaggcacaaaaggacgtcatgctgtcagcgcttgaaaaaagcggcaaaaagactgaagagatcagctatctcgaagcgaacggatcggggtcggcagtaacagatttacttgaattaaaggcaatccagtccatttaccgttctgaatcaaaggctccgttagggctgggatcggtgaaacctaacatcggccatccattatgtgcagaggggattgcgagcctgattaaagtagctttaatgctgaagcatagacaattggttccgttcctgtcaggtaatgaaaatatgccgtattttgatatagaaaaaacagatttgtatttcagcagatcgcaagccgagtggaaggagacaacgccggctgcggcaattaattgttttgcagatggcggaacgaacgcccatctcattatagaagcctggaatgaatcggttgctcgtccaattagaagaaaacctctgcctttgccggaattaaataggcagcccgttttaatcaaaccatcagctcaaaacgtgcaggaaaaagtgcattcagacacaggggcttctaaagatatgttttggaaaactttcaaataagagaggagtgggaaaatgataactgaacaactgcacatttcattaaataatccaatcatgtccaaccacaaggtatatggacaagcgttattacccggccttgcttatatagatttgatctaccaagtattccaggaacatggttatgtataccaagagcttgaattaaaaaacctgaccattttttaccctttgatcgcagatgagtcatatgacattgccctgaccattcacgtgtctgaaagaaaggaagggacatggtccatcatcatcgacggacaaaaacagcatggagaatcactatctgacaagagacaatatgtgactgctgacatgcatcgtaaagagcaaaccgcttttgccgaatcaatagaccttaatcagtggaaaagtacagctgacaggattctgaatttagatgaaatctatgaacaatgccgatctcaagagttagtgcataccggcatgatgaaggcggaaggacagatttatgaagccaaagagggggctgtaattgatttagcagtcggacaggaagcattgcgtcattctgatgcttttctgtttcatccgacgcttattgacggcagcggcataggttcaagctgcctgatctcagatcaaacgatgtacctgccattgtattatgaatcgttttctgcttcagaacgattgcaaaaaggatgtacagcacggatcctctcctcatctgtgcgccaaaagaaagagctcacttatatgacgattgaatattttaattcatcaggacaaaaagtggccgagctgaaacaatttgcaggcaagtctgtacggaatatgtcagcctttcattctccaaaagaaattcaagaagaaagagctgctgtctctcagaacatcagtcaggactatcccgcatttgaaatgtatttgcgtcagctgcttgctaagcagcttgaaaggccggcagaacaaatggatatccacgctgggtactatgagcttggtctggattctccgtcattgcttaccgtggttcaggaaattggagataaggttggagcggatcttgctccgacactgctgtttgaatttacaacaattgcagaactagctgctcatcttgctgatcactattcaattggagaggcggacgatgctgtccgccaatctccttcaccaatgaaggattctcctgatggtgttacctcttcaccagagatcggggaggacattgccattatcggaatggcgggacgctatcctaaggcaaaaaacatacaggaattttgggaacatcttaaagcgggtaccgactgcatcacagagattccaaactcacgctgggagtggaaagaaaacaatggacaggattcacctgcaggcaagccactctcgaaatggggcgggtttatcgaggaggctgattgctttgatcctcaatttttcagaatctctccgcgtgaagcggaaatgatggaccctcaggaacggttatttttagagacatgctgggaagctattgaagatgcgggttatacaccagagacaattgcttcaccgcagggagaaaataaaagacagcatgtcggtgtgtttgccggcgtaatgcataaggactattcccttataggggctgaagctctatcagaacacaatccatttcctttatcgctgaattatgcgcaaatcgccaacagggtctcttactattgtaatttccacggcccaagcatggcggtggacacggtctgctcttcctcattaactgcggttcatctggcaatagagagcatccggaatggagaatgcgaggccgcgcttgccggaggcgtcaatttgtcattgcatccggctaaatatatcagctatggcagtgtaggaatgcactcaagtgacggctattgccatactttcggcaaagacggagatggctacgtatctggagaaggtgtcgggacagtattgctaaaaccgctgcgaaaagctgaacaggacggtgaccgaatctatgctgtcatcaaaggaagtgcgataaatcatgtaggaaaagtaagcggaattacagtaccgagcccggtagctcaagctgatgttatcgaagcgtgtctagaaaaaacaggaattgatccgcgcaccatcagctatgttgaagcccatggcactggcacctcattgggagatccgattgaaatacaggggttagtaaaagctttcagccgcaatacgcaggacaagcaattctgttcaatcggttctgttaaatcgaatattggccatgctgaagctgcagccggcattagcggcttaacgaagactgtcctgcagctgcatcataaaaccttggtgccgtcattacattcagaagagctgaatccttatttgaagcttgatcaaaccccattttttgtccagcatgaaacaaaggaatgggggcagccatcttttacagaaaacggggtggacgtcacatatccccgccgtgccggtttaagttcgtttggcgcttcaggatcaaatgcgcatcttattttggaagaatatattccggccgagagccattcagaaacgattttaacgaaaaatgaaggaatagtgatacctttgtctgcgagaaacaaagatcgtctgcaggcttacgctcttaaacttcttgattttcttagcgaggacgtcaatcttttagcgttagcttataccatgcaggcagggcgggttgaaatggaggagcgtgcggccttcatcgtaaaagacataaaagatttaacggctaaacttcgggcgtttgccaatggagaagaagagatcgagggctgctggaccggacaagccaaggagaatcaggaggcggctgggctagcatcggtaaatgcgctgaataacaatttgacaacagacagtgaaatgatggaaatggcgaaagcatgggttcaaggacagcgggtcacctgggacgacctatacggcgatcgcaagccgcttaaaatcagtgttccgacctatccgtttgcaagggagcgctactggatcccggttcctgaaatgaaaaccagcactgtgaatcatatcttacatccgctggtgcaccgcaatacatcagactttactgagcagcgctttagctctgtatttacaggcacggaatttttcctttcagatcatgttgtacagggacagaagattttgccgggcgttgcctatttagaaatggcaagggaagcagcggaaaaagctgcaggcgatctggacggcaaacaaagagtggtgtcgcttaaagacattgtgtgggtgcgtcctatcacgattgaaagtgaaccaaaagaaatacatattggcctttttcctgaggataacggggaaatctcctttgacatttatagcagctctgaacataaagaagaagccctgacgatacactgccaaggccgcgctgtcatttcagatgaagcggacacttccattttaaacctttcatcaatacagacagaatgcagtttggacacagtgacgtcagaacaatgctatgcagcgtttcgaaagattgggcttgactatggagagggctatcaagggattgaaaaagtctatgtcggcaaagatcaattgcttgcaaaaatctcgttacccgcttttctaaaaaacgacaagcagcattttgcgctccacccgagtttgatggattccgcgttccatgccacagtcggttttatcgttagctcagtcaatgccgctggacaagctcagacgctgtctcttccatttgcgttgcaggaggttgatattttcagcccatgtccagagaagatatggtcttatattcgatacagttcagacagtaaagcggaggacaaagtcagaaagtatgatattgatttatgtgatgagaacggacacgtttgtgtgcgaatgaagggtgcctcgatgcgggcacttgatggagagcggcattcaaggtctcaactagtaactgattctcagctgaccgggcatacgatgatgatccccgtctgggaaccagtctctctagaagcggaggataatgcttcgtttgctggtacacgagttgttttatgcggtgctgctgaagctgatcgggcattaataaagcatcattatccgcaagtatcctttatcgatatccggcctgcagatgacattgagggaatagcggacaaactgcaagcgtacggaagcattgaccatgttttgtggattgccccgtcacaccggggaagtataggtagtgatggacaagaagaagctgttcttcacttatttaagcttgtgaaagcatgcctgcaattaggctatggcgagaaacaacttgaatggtctcttgtgacaatccaagcgcagccggttacgcaacatgaggcagtacaacccgctcatgcaagcattcatggacttgccggcacaatggcaaaggaatatccacactggaaaatccgtcttctcgatcttgaaaaaggctgcacatggccggtaaatcacatgtttgcgctcccagctggccgccttggccatgcttgggcctatcgtaatcagcaatggcatcagcagcaattgatcccatatcggcactcactgtcaggcgacacgctatatcggaaaggcggagtctatgtggtcatcggaggagccgggtatatcggagaggcgtggagtgagtacatgatccgccgctaccaagcgcaaatcgtttggattgggcgaagtcaacttaatgctgccatccagtcaaaaatagaccgactttcggcgcttggccctgagcctttctacattgcagccgatgcagccgataagcattcattgcagcaggcttatgatcaagtgaaaatgcgccatcctcatattcacgggattgttcactctgcgatggttttatttgagcaaagcctggaaaaaatgaagccggaagaattcaccgctggactggcggcgaagatcgatgtcagtattcggatggcccaagtgttccgccaggagaatgtagattttgttttattcttctcttcgcttgtagcccatatcaaaaatgtgaagcaaagccattatgcctctggctgtacatttgcagatgcttttgctcaccggctttctcagagctgggcatgccctgtaaaagtcatgaactggggatattgggggaatagtgaagcggctgaggatgaacattatgtacagctcatgaatcaaatcggcttaggtttaattgagcctgcggaagctatgaaggcgctggaagccctgctttctgggccagtcagccaaacagctttcattcatacgacaaagcctgtagcagtcgaaggcgtgaatcagaatgaattcatcgctctttatccagagcaaccttcagcagatgcagagagcctgatggagcgtctgccgactacggcacgatttcaaagagtgacacatgaagagcttgatgatcttctttacaggctgttgttaggacagcttcaaacagccgggctgtttgatggttatacattatcggttgaacgtcttcaacaatataagactcgtgaattttatggaaaatggattcggcaaagcagcgaatttctcttgcagcatggctatcttaagaaagttggagattcattggtgaggaaggaccaagcagaggatatcgagctgctttggcaagaatggaatgcgaaaaaagaaaagtggcttaaagacagcgagacaaaggcgatggttgtattagcagaggccatgctgaaagcattaccggatattttgacagggaaagtccctgcaacagatatcatgttcccgcattcctcgatggaactggtggaaggcatttataagcataacaaagtggcagattattttaataaagtgcttgccgatacattattagcttatctggatgaacgtctgaagcacgaccctgaggcatcgattcgcattatggaaataggcgcaggcacaggcggcacgagtgccggaatctttgaaaaactgaaaccatatcaaaagcatatcaaagaatattgctatacagatctgtctaaagcatttttgctgcatgcagaaaaggaatatggggcggaaaatccgtacctgacatatcagctttttgatgtggaaaaaccgattgatcagcaggaatttgaagcgggaggctatgatgtcgtcattgccgctaatgtccttcacgcaacaaaaaatatccgtcaaacactgcggcatacaaaagcggtaatgaaaaacaacggaatgctgctgctgaatgaaatggcgggaaacagcctgttccctcacatcacctttggtcttttggaaggctggtggctgtatgaagatcctgcagtgcggattcccggctgtccaggcttacatcctgacagctggaaagcggcacttgaaagcgaaggctttgaatctgtctttttcccggccgaggcggcacatgatctgagtcaccaaatcgttgcagcctcaagcaacgggctggttcgccgtatgatgaaaaatgtgatcttgccggagaaggttgtttcacaagcgtctaatcaggagccagcctacattcataccatagattcagaggaagctggacaatcaaaacatgctctcctaagagaaaaaagcacagaatatatgaaaaaactaatcggggaaacgttgaaaattcctgcaggaaagattgagtcatctgaaccgcttgaaaagtacgggattgattctatcgttgttgtccaactgacaaatacattgcgtaaagaatttgaccatgtaagcagcactttatttttcgagtaccagaccattgacgcattagttgatcatttcatcaaaacaaaaacagaagcgctgatgaaattaacaggtcttgaccgtcaagttcaacaacagacaccggccgaaagcagaacccaatcctcacagaaacctgatcaggccgctaaaagaacacggcgctatcgcaagcttggcttcagcggggagaaagaaacaccgacaaacactcttgcaagccgtgacgttgccattatcggcatttctggacgctatcctcaggcggaaacagcagaagacttttggaacaacctaaaagaaggaagaaattgtattgaggaaattccgaaagatcgctgggattggaaagcttattacgataaagaaaaagaaggatcaatttatacgaaatggggcggatttatcaaggatatggacaagtttgacccattattctttcagatttctccgcttgaggcagaaagaatggaccctcaggagcgattatttctgcaaaccgcttatgcaagtattgaagatgcgggatacacgcctgactcgctctgttcaagcagaaaaatcggcgtctttgccggagtcatgaacaaaaattatccgaccggctacggctattggtctatcgccaacagaatatcctatttactgaatttccaaggcccgagtcttgcagtcgatacagcctgctcatcctccctgacagcgattcatttagcgctggaaagcatctatagcggatcgagtgattgtgccattgccggcggtgtcaatttagttgtcgacccggttcactatcagaatttatctgtcatgaatatgctctctgctagtgatacatgtaaatcattcggcgatgatgcagatggatttgtcgacggtgaaggcgtaggcgccattgtgttaaagccgctgcagcaagcaatagcggacggtgaccatatttacggtgtgataaaggcaagtgccattaatagcggaggaaaaacaaatggatacacggttccaaatcctcatgcacaggcacaggtaattaaagaagcaatggagcgcgccgacattcctgcccgaaccatcagttatttagaggcgcatggaacaggcactgcattaggagatccgattgagatagcggggttaacaaaagcatttgagaaagatacgcaagagaaacagttttgtgcgatcggctccagcaaatcaaatatcggtcattgtgaaagtgcagccggaattgcagggctgacaaaaatactttttcagtttaaatatggccaaattgcgccatcattgcatgctcagcggttgaatccgaacatcgagttcagccatacgccatttgtcgttcagcagcaacttggtgaatggaaacgcccggtgattggcgggcaagaggtgcctaggcgcgctggcttgagcagttttggcgccggagggtccaatgcccatatcatcctggaagaatatattccaagaacgggggcgcaaacgccgaaagaccatcctccagcgctgattgtgctgtcggccaaaaacatggaacgcttgcaagaaaaagcggaacagctgcttacagccatcaaacaaaaaaggtaccgcgaaacagacctgatcaggatcgcctataccttgcaaacaggccgtgaagcaatggaagaacggctggcctttatagcggaatcactagaggatcttgagagaaagctgaacgattttatcgaaaacaaagcagacagcctgtatctggatcgcatcgaggataacaaaaaagcgttagcagttttatcagcggatgaggatacggaaaaaatcatagaagcatggatgagcaaagggaaatacacgaaactactggatctttgggtgaaaggcttgtctttcgactggggcatgctgtacggcacccaaacgcctgtccggatcagtcttccggcatatccatttgcaaaagaacgttactgggcaccaggcgcggcaaaggctccggcgtctatagaacaggatcatgatcagcaaacagaagaacctttcaaggttatgacttttcaagaagtgtggaaagaagagccggcgactctcacatcgaaacgtatcaaaacgctcatctgttttctgactgaaagagaaaagcaaaacgcatttgcttcagccctgaaaaacgttgatcaagacaccaaggtcatttttatatcacagggcgaagtgtacagcaaacagtctgaatatagctaccagattgtgcggcaagaacccgttacttttgaaaaggccttccagagcattaaagaagaacttggagagccagatgcaatcctctatatgtggcctatggaagacaagcgctgtataaaggaccattcctgtattgtttacctattacaaggtatgtccgcagcaaagcttcatccttcacggctgctgctggcaggatgttttgaagatggtcttgaccgaagttatctggaatcatggattggcttcgaacgttcactcgggcttgtcctcccgcacacaaaagtgactggaatctttcagccggtggaacaaggatcgatggatgattggacacgtaaaatatggggagaattacaggcttcagctgaacaaacggttttgtatcagaatctgaaacgatatgtaaatcacattgaacagacaacgatacaaccggacgacagcaaattgaagtctggcggtacttacctgattacaggcggtgtaggagggcttggttatttatttgccaagcatttggccaaaaactatgccgcaaacctgattttgacagggcggtcgccttttaatgatgaaaagcaaaagcaaataaaagaattaaaggatctaggcggcgaagcgatgtatgcagaagcagatgtgtctgatcctatcgcaatgggagactgcgtaaaaagagggaaagaccgattcggtgccatcaacggtgtcattcatgcagccggaatcgagagcgactctgctatttttgacaaaaagatcgaaagctttcagcgcatcattgaaccgaaaatcaacggcacgatagcgcttgatgaatggcttaaaaatgaagaccttgattttatgtgttatttttcttcttcttctgcggttttaggggattttggatgttgtgattatgcgattggcaataggtttcagatggcttacgcacaatacagaaatgagctgcataacggtaaaacgtttgtcatcaactggcctgtatggaaggatggcggaatgaagatcggtgatgaggaaacaacggatatgtacctgaaatcaagcggccaacgcttcctagaagccgaggaaggcatccgtatgtttgagcacatcctagctcagcaggatgctcagcatctcgtgatagccggtcagcccagccgtgtcagcagatttttaggaatgactgaaccagctattccagaaccggccactcaagcccctctagcacaagaaaacaaggatgaggtaaaaacgttaagcattgaaaagcgtttagaacacgacttgaaagagcatattcacacattgcttaagatttcaaaggacaagctgaatttgaacaaaaattgggccgacttcggatttgattcaatctatttggctaaattctcgaatgtgttatcaaagcatttcaacatcgaagtgacaccggctttatttttcggctattcgactttacaagaattgatcggctttttcttaaccgatcataaagagctgattgaagcattttaccgggatgatgcatcagaggcgcaaaagccccctgaagcttatgcagcaattcctgtagctccagaaccggaaaccagtaaacaaagcattcggcaggttcacgatgagcctattgccattatcggcatgagcggcaggttccctcaagctgattcggtccatgagctgtgggataatctgaaaaaaggtaaatcgtgtatctctgacatcccgggcgaacgccgggactgggggagagctaacagagatccagaaaaagcagtgccaaggtggggggcatttttgaagggcatagaccggtttgatccgctgttttttcaaatatcgcctaaagaagccgaaagcatggacccgcgccagcgcatttttctagaggaagcatggcacacgtttgaagacgccggctatatgggagatcggataaaaggaaaatcctgcggtgtttatgtaggtgtggaagaaggggaatatgcgcatctaaccggagatacggattacattaacggaacacaaaacgccacattgtctgcgagaatcgcatacgcattggatttaaaagggcctaatatggctttgacagcagcatgttcatctggactggtagcgattcaccaggcatgttcagctctgcgtcagggggattgtgaaatggctttagccggcggcgtcagcttgaatatttctcacatgtcttttgaggcgctgacaagggccgaaatgctgtctccgaacggacaatgcaaagtgtttgaccaggatgccaatggtcttgtgccaggtgaagcggtggctgctgttctcttgaaaccattatcaaaggcaattgaagataaagatcatatttatggctgcatcaaggccagcggcgtgaattacgatggcaaaaccaacggcattactgcgccaaatccttttagccaggcagaattgatcgaaaacatttatgaaaaaaatgaaatcaatccgctcgatattcaatatgtgatggcgcacagtaccggctcgaatcttggtgatccgcttgaggtccaagcgttaacgagcgtgttcagcaaatatacgaagcagaagcaattctgtatgatcagctcaattaagcctttaatcggacatacatttgcagcgtcaggaacggttgctttaatcagtatgctgatggctatgaaaaaccagatgattccggccactcatcactgtgaatcggaaaaccagtatattccgtttaaagaaagcccatttgtgctttgcaaagaaaaccgttcgtggatcaggaaatatcagaagccgaggatgggaacgatcagcacgactggaatcagcggcaccaatgcacatgcagtcattgaagaatacattccggaagatcagccgcccacacagcggcatcaagggtcaccgcaggtcatcgtgctttcagcccaaaatgacgatcggcttcaggatgctgcctgccgcatgattgcgtatctggagcagaatcataacctttctttacctgatatggcatatacgcttcaggttgggagaaaagccatggaagcaaggctcgcgatcgttgcaaacaatcagaagcaattggtgcaaaaattgaaggaatatgtggaagcaatgaagaatggtggggtatcaggccaacagagatccctttatacaggatatacagaagggattttagaagaacaagatgaagcagttctgcaagctctcgcaaaagaaagaaatttggaaaacatcgcggattgctgggtgaaaggatatcagattccttgggaactccttcatgatggcgatcacgttcgaatggtttctttacctggttatccatttgcaagggagcggtattgggtttcgtcaggcacccagcaatcagtggccgttaaacagcattcacaagatatgaaaacagagattgacgagccgaatggcaaaaaccatattcaaaagatcattgttcaatttttagcacgagaattgggcatatctgaggatcgaatcaatttcaaaagaaactttttggattatgggatggattcaattcttggccgaaaattgatgcggcatatcgaaaaaaccacgcagctgaagatggccggtcgggaaatccttgaatgtcagacagtccaagctctatctgaccatttggccttaaaagcggaaaaacaaaatcatagcgcagcagcacatcaaataaaggacacgtatacagacgggcaaatcatcggattaatgcaagaggtggcgctagggaaattggattttaagagtgtgcaaaacatcatagaagggagtaaatcgtatgaatcataaagaaattctcgatgccttcagatcaggagaattaaccatttctgaggtggaagaacatcttaaaggcatgaagcggcagttgaaaagcccgctttctgaagggcaaaaagggctgtggatgcttcaaaaaatgtctcctgggatgagtgcatatcatattcctttatgctttcgcttcagcaaaccaatacatgcagagacgttcaagaaagcccttctgtttgtacagagacaatatccgatcttagccagtgtgattcaagaagaaaatggcattccatttcaatcggttcagttatcaaaggatctttattttgtggaagaggatatatcagcaatgaaatcagcagatatctttccttttctaaaagaaaaagcaaaagaacctttccagttggaagctggtccgttatggcgcacacacctttttcatcggttagaagaatgcattgttcttataacaattcaccatatcatatttgatggtgtgtcgatgctgacattgatatcggcgctattcgaagcgtatcaacaattgctgaatgggattgagcccttgcagcagccattaacagctgattattacgattttgtcgattgggaaaaacggatgctgactggcagagaaggggaagagcatctcgcttactggaaagaacagttgtctgggagtctgccagttcttgatttgcctgctgaccgtccgcggtcttcatcacgaaaattcaaggggcaagcttataaaagcttgctcccccatcacctgagcaatcaaattaaatcgtttgcccgcaccaatcatgtgaatgaatcggttgtgtttctctccatttacaaagtgttgctgcatcattatacaaaacaaaaggatatcattgttggcgttccgacaatgggtcggcaagatgacagatttgaaaccctaatcggttattttatcaatatgatggctgttcggagcaagaatatcggatctcagccattaacagcatttattcgggaactgcagctgacagtggctgacggcctggatcatgcggcgtttccgttccctgcattggtaagagagctgaatgtagaccgatcggccgcggattctccggtttttcaaacagcttttctgtaccaaaacttttttcaggcaacaggcttgcaaaaagtgctcgaaccgtatcaaacgcttggcatcgaatatattgaagacattcggcaagagggtgaatttgagctggcgctcgaaatatatgagcaagaaaatgaaacagtgcttcatcttctgtacaaccctgatttgtatgaactgtcctccattgaaaacatgatggagaactatatgaagctcgcgcaacacatgatggatgacccgtctttgccgcttgaagcctactctttgcgattaaatcaagaacaaactaatttggtggaacaatggaatgcgacagggacaaacatcgcaaatgacaagtgtatacatgaggtgtttgaggaaaaagcgaaacaaacccccgatgcggttgctgtgatgtttgaagacagatcacttacatataaagaagtagatgaaaaaagcacatctgtggcagtctaccttcaacatcagggtgttagacctgaacagcccgttggcatttgtgcagagcgttcgtttgatatgatcatcggaattttaggaatactgaaagctggcggagcgtatgtgccgttagatccaagttttccgcaagaacgattagagtacatgctcaaagacagtcaggcatccattgtcctcacccaacctaacgttcatgataggatcagcggattaactggcagccatgtaaaagcgatcaatatcgagttagcttgccgaaacgattatacagaccagcaaagcagcggtttaaagcgggaagtaaaaccggaacacctcgcttatattatttatacatcgggaagcaccggagagcctaaaggggttatggtagagcatcggagcattatgaataccctgaattttcttgaatctcactatcctgtaacggctgaggatgcatatttattgaagacgaactatgtgtttgatgtatcgatctcagaattattcggatggtttattggagacggccgtcttgtgattcttccgcctaatggggagaaatcaccgcagctttgcatggattatattgaaacatataaagtgactcacattaattttgtgccggccatgctgcatgtttttttagaaatggcgaaagacaacaaacgattcacagaggatggtccgctgaagtatatgatggttgcaggtgaagccttccctaaagaattagtgaaaaaggcggtatcactctttacaaactgccgtgttgaaaatatatacggaccgacggaagcctccatttacgctgcgtatttcggatgcggaaaaggagatatcgcaagtcaccatacaccgattggaaagcctgtctccaacacgaaaatttatattgtggaccagcatttaaagcctgtcccgatcggaaagcctggtgagctatgcatcgctggagccggcttagcaagaggctactttaaaaagccggggcttacggctgaaaaatttattgataatccctttgaaccagggacgaagctatataaatcgggtgattcagcaaggtggcttcctgacggcaacatagaatacttgggacggattgacagccaagtcaaaatacgcggttttcgcgtcgagctgggcgcaatagaaacaaagctgagtgaatttccgggcattttagatcaggccgtagtggtgaagcagctggaaggccatcaacagctcgctgcttattatacagaggaaagcggacatgcctctgccaatccaaaagatttgcgccttcatctaaaatcgagtctgccggaatatatgataccttcacactttatccgcttagatgagcttccattatcgcccagcggaaaagtgaaccgtaaagaattagaaaaacgcgagatcgtgttcaacataaggaaaccaaatcacttgcaattaacggaaatagaggatcaggtgctgcgcatttgggaggaaacgctcaaggtcagcggatttgggccggatgacggatttttcgatgcgggcggcgattcgcttctggctgtagctgtggctgaacgaatcaaaaaagaattcgattgtgagtttcatgttactgagctgtttgagtattccacgatccgtgcaatcagtgaatacattttggagatggaaaactcagatctagccgggacacaaaatgaagatcattatgatatcaaaaaagatagaaaacacctagaacagaagattcctccttattttgacgacagtgttgcgattgtggggatatcttgccagttcccgggtgcgaaaaatcatcatgacttctggaaccacatcaaagaaggcaaagaaagcatacgattcttttctgaagaagagcttcgcgcaaatggagttcccgaagaattgatacagcatcctgactatgtgccggtgcaatctgtgatcgaaggaaaagacttattcgatcccggtttctttcaaatctcgccaaaagatgctgagtatatggaccctcagctccgcctcttattgctgcactcctggaaagcgattgaagatgcaggatatgtggctaaggagattccggcaacaagtgtatatatgtctgcaagcagcaattcatatagaacgttattgccgaaggagacaacagaaggacatgaatcaccggatggctatgtctcatgggttttagcccaaagcggaaccattcccacaatgatctcacataagctcggattaaaagggccaagctattttgttcattctaactgttcttcatcactagtcggtttatatcaggcatacaaaagcctgacatcgggcgaatcacaatatgcgcttgtcggaggcgcaacattgcacgcacaatcagcgatcggctacgtgcaccaaaacgggttgaatttttcaagcgacgggcatgtgaaggcgttcgatgcttcggcggacggaatggccggaggtgaaggcgtagcagtcatcctgctgaaaaaagctgtggatgccgtaaaagacggagaccatatttatgccattatgcgcggaataggcatcaataatgatggggcagagaaggcaggcttctatgcgcctagtgtaaaaggccaaacagaagtgatacagcatgtattggatacaaccaagatccatcctgaaacggtcagttatattgaagcacacggtacgggaacgaaattaggcgatcctattgaaatgtctgcgctaaataaagtgtacaagcaatacaccgacaaaacacaattttgcggaattggttcagtgaaaacgaatatcggccatttggatacagctgcggggttagccggatgcattaaagttgcgatgagtttataccataatgaacttgcaccgaccatcaattgtacggagccgaatccggatataaagtttgaaagctctcctttttatgttgtccgtgaacgaaaatcgttagagaaacacgcaggtgtccatcgggcggctctgagctcattcggccttggcggaactaacgcccatgcaatatttgagcaatatgaaaacatttctgatgcaggtaccgaaaacgaaggcaatcagccttacatcattcctatatcagcaaaaaatagtgaacggctccaagtatacgcgaaggaaatgctgtcctatatcagtcaagacgagcaaaggcatttctctttaagagatattgcatataccttccaagtcggccgtgaagcaatggataacaggatcgtttttatagtgaacgatctggaagagtggaaacatcagctggaagcttttgtgactggaaagccgctcgcagaaggctgtattcaaggagaaaaaacgagaatgacatccgctgaacagctgcttggaaatgctgaagcagatgatatggcttcatcgcggatatcaaaagaagaattgagaaagcttgccgagatgtgggcaaatggctttcacgttgaatggcgcaggctctatccaaatataaagccacgccgcatcagcttgccgacatacccttttgccgaagaacgatactggcctgaaagcagcaccggcgctatcacaacaattgaaccatctcgtttgcatcctttggtgcaccataatacatcggttctgtcagagcagcgtttcagctccattttcacaggacaagagtattttattgccgagcatatcattaaaggcatggcgattttgccggcggcggtcacgcttgaaatggcaagagccgctatagaacaaggaattggcggattggaggatcatgaaactggaatcaggctgaaaaatgtcgtgtgggttcgcccggttgtagcaggaagtgagccggttcaggtaaatatcggactttacgatgaagatggcggacatattgcttatcggatgtatggtgatccggaatacgctgatgcagaaccagttgtatataaccaaggtaaagcggaattgattcagttaaagcgagaaaaagcactggatctttctaagatcaagaaacaatgtgatcaaagcaaaatggatgctgcctcgttttatgaagggatgatcggcgccgattacggtccaggttacaagagtgtagaggccgtatataaaggcgacggccagctgcttgccaaattatcactgccagaatctgttgcacatacgttgggcgattatgttcttcatccaagtgtaatggacggggcgttacaggcggctgaatatttgcaaaatgtcgtcagagcggaactttcagacactgaagactttaaggcagcactgccatttgcactggaggaacttgaggtttttcgtcagtgcgtttctgacatgtgggtttatgttcaattcaactcgaaaaacaaaccgggagatttgatacagaaagtcgatattcacctatgtgatgagcatggcatgatctgtgtgcggctgaaaggattttcgacgagagtgatggaggcagatatacaaaccgaaccatcaaaaatcaacgctgaaactttattgcttcagcccgtttggcaagaacaaaaggctgctaacagcttagctgcaaaaaaatatgcagagcatctcgtattcctatgtgaatatgatcatgagacgagaaaacaaattgaagcagctatcgaggatgtccatgtatacagcctggaagcaaggccttcttcagtagatgggcgtttccattcttatacagaacaagtgtttaaaaaggtacaagagatcattcgtacgaaaccgaaagacggcattctcgttcagatcgtgacctctgccgagggagaacagcaattgttttcagggttgacaggactgctgaaaacagcttgtcaggaaaatgccaaactaaccggccaaatgattgaagtcagcagtgaagaaagtggagaaagcattgctggcaaactgttagaaaatcaaatgagcggcgattcatatgtcaaatatcaaaacgggacacggtatattgctgattggcgtgaaatcaaacaggcaaaaggagacggcagcaaaccgtggaaagacaatggcgtttatctcattacaggaggtgccggcggactaggtcatatttttgcaaaggaaattgcggaacaaacgaaaaatgcgacagtcattctggcgggccgctcacctcttagcgaaagcaaaagcaaaaagctgaaagagcttcatagcaagggggctgacatcacctaccggcaaacagatgttaccaataaaattgaagtctatcagctcattgacgacattcaaaaaagatatggccgtctgaacggtattcttcatagtgccggaatcatcaaggacagctacctggttaataaacaggcaaaagatctgcacgatgtactggcgcctaaagtaaaagggcttgtttatctagacgaagcgagtaaggatttgcctttagacttctttattctcttttcatctctttcaggaagtttagggagcattggtcagtctgactatgcggcagccaatgtatttatggatatgtatgcaggctatcgaaatcggcttgccgacctcagccagcggcatgggcagacgctttctgtaaactggcctttatggagagatggaggcatgcaggtcgatcaagaaactgagaaaaggcttgtgcaacttgccggtattgttcctatgagggcggaaaaaggaattcaggcattatatcaagcacttcattcagaggcaaaccaagtaatggtgatcgaaggcgatgtgcagaaaataaaacaaaacatgctggccaaaaacgcctcagcacctatggaaaagaaggaagcagaacacatgactgaacaaataaatagcattgatgcagacagtttgctggataaagtaaaggcgatgttaaagcgagagatcgccaagctgttaaaggtcaagcttgaaacgattgatgatcatgccgagatgacggtgtatggttttgattctatctccatgactgaattcaccaaccatatcaatcgcgcctatcagttagagctgacgccaaccgtattttttgaccacccgacgattcatgcgtttggcaagcatttgtcagaagaatatcaatcggtatttgcgaagacatttgctgtgcgcgctgtatcggctcagattcagcctgccgcgaaacaggaacaagccgtgcgtgccaaagctaaaagacgcagaaagcagcaagtcatgctgccaaacgccatacagagtgatgctgggcctgagccaattgccattgtgggcataagcgggattttccctatggcgaaagacgttgaggcgtactggaacatcttaaaagagggcaaagactgcatgacggaaatcccgaaagatcgctgggattggcgtgaatatgaaggtgatccggcgaaggaagtcaataaaacgaacgtgaaatggggcggttttattgacggtattgcagattttgatccattattctttggcatttccccgcgtgaagctgaacaaatggaacctcagcagcgcttactgctgacttacgcctggaaagcgatcgaagatgcaggatattcggcgaaaaggttgtcaggcacaaagaccggcgtcttcatcggaacgggaaatacaggatacagctctcttctatctaaagcgaactcggcaatagaaggatcagcggcagccaatacgagcccatcggtcggtccgaaccgggtcagttatttccttaatctgcacgggccgagcgaaccgattgatacagcgtgctcaagttcactagtggcgatccaccatgccatctcttcaattgaggaaggcacttgtgacatggcattagccggcggtgtaaatacgattatccttcctgaggtgtatatcagctttgataaggcgggagcactgagcaaagaaggaaaatgcaagacgttttcaaatcaagccgatggttttgcgcatggggaaggtgccggcatactgttcctgaaaaaattaaaagcggctgaagaagcgggagaccacatttacggagtcataaaaggcagtgcaatcaatcacggcggccgtgcagcctctttaacgactcccaatccgaaggcgcaggcagatgttattcagtcggcatatcaaaaagcgggaatcgatccgaaaaccgtgacctacattgaagcccacggaaccgggacggagcttggagacccggttgaaattaacggtttgaaatcagcttttaaagcattgggtgtaaatgaaggagacacatcagtcaatccttactgcggtttaggttctgtaaagacaaacattggccacttatcgctggcagccggtgcagcaggagttattaaaatattattgcagcttaagcataaaaccttagtgaaaagtctgcattgcgaaaacgtgaatccatacattcagctgaaaaacagtccgttctatatcgtacgggaaacggaagaatggaaagcgctgaaaaatgaacggggagaagagcttcctcgccgggcaggtgtcagttcatttggaatcggcggggtaaacgcccacgtgattatcgaggaatatattccggaagcatccgatgagaatataccatccatcacgccggaacatccgggtatcttcgttttatcggctaaaaataaagcgcggctaaaagaacatgcacagcagctggcagatgcgcttgataagcaatcatatagtgacgtaaatctcgcccgaatcgcttatacactgcaagccggacgggatgcgatggaagaacgtctcggggttatctccggttccattgaggatgtacagcaaaagttaaaagactttgcagcaggcaaaagcggtgtggaggatgtatttaaaggcaggattgataaaggcacactccaaatgctgacagaggacgaagagattcaagaagctgtcgagaaatggatggaacggggaaagtatgcaaaattgcttgaattatgggtaaaggggcttgatgtagactggacgaaattgtatggcgagaatctgccaaagcgcatcagcttgccgacgtatcctttcgcaaaagaccgttattggatctctgatcatattgaaaaaatcggcagcattgatgcaaatcaagcagcctcccgccttggcggagccgtgctgcatccattaatgcatcaaaacacatcgaatctctcggaacaaaggtttagctctatttatacgggagaagagtttttccttgctgatcatgttgtgaaaggccaacggattttgccgggagtggctcatcttgaattggcgcgggcagctgttgagcaggccgcagaggtagaaggtgtaccgtgcaccatgaagctaaagaatgcggtgtgggtgcggcctattgttgtagaggatcagccacagcaagtacacattaggcttttaccgggagaaaatggtgagatctcttatgaaatctatggtcattcagacgttactggcgaacagtcaattgtctacagtcaaggcagcgcggtattgaatcctgctgaaaatctgccggcggttgattttcaatctctgcgggagcagtgtcaggaaagccatttcagcgtaaacgaagtatacgacacctatcgaatgattggatttgaatatggtcctgcttatcgcggagtgaaaaaaatctatacagctgaacaatttgttttggcaaaattgtcattgcatccgtcagctgcagatacgctcagccaatacaaaatgcaccctgggctgatggattctgctttgcaggcgtcaagcattttgacaggcgccggggataaccagctgacactgccttttgctatccaggagcttgaaatcttcggagcatgctcgtcagaaatgtgggtatacgcaagatacagccaaggcagcaaggcaactgataaggtgcaaaagcgcgatattgatattttagatgagagcggcaacgtttgcgtacggatgaaaggattatctttcagagcagcggaaggcggctctggatcggcggaatctgatcaaacgctggcaaccctgatgtttgaagaaaaatgggtgcctaaggattttaaaaaagaaagtcctgagcctcattacgaacggcacattgtcatgctttgcgacatgaatggcctctcaaaagatcgcattgaatcaagattgacaggagcggaatgcatcgttttggagtcattccgcgaaggacttgcagagaggttccaagattatgccgaacaagcgcttgagacggtccagggtcttctcaaaagcagacctcagggcaatgttctgatccagctgcttacctctgcacaaagaaagcagtactcattctcagggctatcggcgctccttaaaaccgccggcctggagaataaaaaactaatcggccagacgattgaaatcgattcacatgaaaatgttgaaagtgtaatagaaaaactgaaagagaataaaaggcacacagaagatcagcacatcaaatatgaaaaaggcaaacggtacatcaatgatctggatgaaatgcaaatagatgatcgggaaataagcatgccgtggagagataaaggtgtatacctcatcacgggcggcgcaggaggacttgggtttatttttgcaaaagagattgctcgtcaagccgaacagcctgtactcattctgacaggcagatccgcgttgaatgcggatcagcaggcggagcttaacgaacttcagcaattaggggctcgcgcagaatacaggcaggttgacgtgacacaaacggaagcagcctccgagcttatcacaagcattacgtctgattacgaagacttgaatggtgtcattcacagcgctgggctgattaaagataactatcttatgagcaaaaccaatgaagagctgacacaagttctcgctcctaaggtgaaagggcttgtgaatgtggatgaggcaaccgagcatcttgcgttagatttctttatcctcttttcttcaatatcaagtgttgccggcagcgcgggacaggccgattatgcaatggctaatgcatttatggacagttatgctgcttatcggaatgcgcttgtaaccgccatgtacaggcacggacaaacgttgtcaatcaattggccgctctggaaagaaggcggcatgcgcgcgaataaagaaattgaaaacatgacgttgaaaaacacaggtgtgactccaatgcggaccgagaccggcattcaagcgctgtataaaggtttggcatttggcaaagatcaagtcatcgtcatggaaggattcaaagacatgatgagggaaaagctgactcaaaagccgtcttctgatgatgtaccaatgaaaacagtgcaagtacgggtgacatctgaagcaagaatggatcaagggaatatgtttgaccacattcaagaagttttaaagcaaacaatctctcaattgctcaaaatcaaacctgaagagattgacccggacatggagtttaatcaatatggatttgattcgattacgttaactgaattcgcaaatacactgaatgagaagtgcaagctggatcttacgcctacggtcttctttgagcacgcaactgtttatgcatttgcagggtatctgtcagaagaatatccaaatgcttttacagctcaaacgcctgccaaagctgaggtgctaatgcagcctgtcgaacagaatataaaaaatatgacgttttcgactgaaaaccgctttgtaaaaccttcggtaacaccaatgcaaaaggaagctgatcacaagcctgagcctattgcgattgttgggatgagcggcgttttcccaaaggcaaaagacgttgaggaatattggaagaacctgtcatcgggcgcagattgtattacagaggttccaaaagaccgctgggattggcaggagtattacggagaccctctgaaagaagcgaataaaacaaacgtcaaatggggcggttttattgatgaagttgctgactttgatccattgttcttcggcatatctccgctggaggctgagcagatggagcctcagcagcgcctgttgatgacctatgcgtggaaggcggtagaagaagcgggacactcagcgagaagcctggcaggaaccaaaacgggcatcttcattgggacaggaaacacagggtacagttcacttctgtcaaatgtagacatcgaaggctcagcggctgcgaatatgagtccttctgcaggaccgaatagagtcagttatttcctgaacattcatggaccgagtgaaccgatcgacactgcgtgctcaagctctttggtcgccattcatcatgcggtttgcgccattgaaaatggaaactgtgaaatggcgattgcgggaggggtcaacacggtcgtaactccgcaaggccatatcgcctatgataaggccggggcgctgagcaaagaaggaagatgcaaaacattttctgacaaagccgatggattcgcagtcagtgaaggtgccggcattctctttctaaaaaagctgacagcggctgaacgagacggtgatcatatttacggtgtcattaaaggaagtgcggtaaaccacggtggccgcgcaaattctctaacgactcctaatccgaaagctcaggcggatgtcgtaaaaacagcatatgaaaaagcgggaattgatccaagaaccgtaacttatattgaagcgcatgggactggaaccaagctgggcgatccagtagaaatcaacggcttaaaagcggcatttaaagagctgtatgaaaaaacgggggacccggctgttcatggcagccattgcggacttggatcagcgaaaacaaacatcggtcacttatcgcttgcggccggtgtggcgggtgtcattaaagtgttattgcagctcaagcataaaacgcttgtcaaaagtctgtacagtgaaactgttaatccatatatcagactggatgacagcccgttttatattgtgcaggaatcgagagagtggcaggcgcttcgggatgaagctggccgagagctgccgcgccgcgcaggcatcagttcgttcggaataggcggcgtcaatgcccacgtggtcattgaggaatatattccgaaagaaacaacccatcctgcaacagcaccagccgtgacagcacagcacccgggcatctttattttgtcggcaaaggatgaagatcgtctgaaagaccaagcccggcaattagcagactttatcagcaagcgatctatcactgctcgtgacctcactgatattgcttatacactccaagaggggcgtgatgcaatggaggagagattagggatcatcgctgtctcgactggggacttgctggaaaaactgaacctctttatagaagggggcaccaatgcgaagtacatgtacagaggcagagcagaaaaaggtatcgcacaaacattgagatcagatgacgaagtacagaaaacgctcaacaatagttgggagcctcacatatatgaaagactgcttgatttatgggtaaaaggcatggaaataggctggagtaaactgtatgacggcaaacagccgaaacgcatcagcctccctacctatccatttgcgaaagaacgctactggataacggatacgaaagaggaggcagccgcccatcaaacagctttaaaaacagtcgaatcagcagctttgcatccattgatacatgtcaacacatctgatttgtcagagcagcgtttcagctcggcctttacaggtgctgagttctttttcgccgatcataaggtgaagggaaaaccggttatgccgggcgtggcatatcttgagatggttcatgctgccgttacaagagcagtgagaagaaccgaagatcaacaatctgttattcacatcaaaaatgttgtgtgggtgcagccgattgtggcggatggccagcctgttcaagtggatatcagtctaaatccccagcaggacggcgagattgcttttaacgtctatacagaggctgcacacaatgatcgaaagatacattgtcaaggcagtgcttcaatccgtggggcaggagacattccagtccaggatatcagcgcgcttcaagaccaatgcagtttaagcacactctcacacgaccagtgttatgaattgtttaaggcgatcggcattgactacggacctggttttcaagggatagatcggctttacatcggccgcaatcaagccttggcagagctttctctgcctgctggtgtaactcacacactgaatgaattcgttcttcatccaagtatggccgactctgctttacaagcgtcgatcgggctaaagctgaattccggtgacgagcagctttctctgccttttgcgctgcaagagctagaaatattcagcccgtgtacaaataaaatgtgggtgtctgtgacatctcgtcctaatgaggacaaaatacagagactggatattgatttgtgtgatgaacaaggccgagtgtgtgtaagaatcaaggggattacctcaaggctgctggaagaaggcatacaaccgccagacgggccgacatcactaggaaactccaaagcaactcttaacggagcgcttcttatggcgccgatatgggatcgagtgcagctggagaagaggagcatttcgcctgctgatgagcgtgttgtcatcctcggaggggatgacaacagcagaaaagctgttcaaagggagtttccgtttgccaaggagctgtacattgagccgaacgcatcaattcatagaattacaggccagcttgaagcactcggatcgtttgaccacatcgtgtggatgtctccttctcgtgtgacagagtgcgaagtcggcgatgaaatgatagaagcccaagatcaaggcgtcattcaaatgtataggctcattaaggcaatgctttctttaggctatggacagaaggagataagctggacggtcgtgacggtgaacacacaatatgttgatcagcatgatattgtcgacccggtcgatgccggggtacacggcctgatcggttcaatgtcaaaagaatatccaaattggcagacaaagctgatcgatgttaaaaaatacgaagatctgccgttatctcaactcctttccttgcctgccgatcaagaagggaatacgtgggcctatcgaaacaagatttggcataagcttcgtctaattccagtacacaacaatcaaccggtgcacacgaagtataagcacggaggtgtttatgttgtcataggcggagctggcggtattggtgaggcgtggagtgaatatatgatcagaacatatcaggcgcagatcgtttggattggcagaaggaaaaaggatgcagccattcaaagcaagctggacagacttgcacgtctagggccagccccgtattacattcaagcagatgcggctaaccgagaggaattagaacgcgcgtatgaaacaatgaaacaaacgcatcatgaaatcaacggcatcatccattctgcgattgtcttacaagaccgaagcctgatgaatatgagtgaggaatgtttcagaaacgttcttgctgcaaaggttgatgtaagcgtgcgaatggcccaagttttccggcatgaaccactggattttgttttgtttttctcttccgtacaatcgtttgcaagagcttccggacaaagcaattacgctgcgggctgcagttttaaggatgcttttgcacagcggctgtctcaagtatggccttgtacagtagccgtgatgaattggagttattggggaagcattggtgttgtttcatcaccggattaccaaaagagaatggctcaggcaggcataggctcaattgaagcccctgaagcaatggaagctttggaattgctgctcgggggaccgctgaagcagctagtaatgatgaaaatggcaaacgaaacgaatgatgaagcggaacagacagaagaaacgattgaagtgtacccggaaactcacggctccgccatgcaaaagctgcgaagctatcacccgggtgacagcacaaagattcaacaactgttataggaggagaagcgccaatgctgaacacagaagacattctctgtaaaatgcttttcgcacaattacagtccatagggtttttcacagaaagtaaatcccagccggtattggagaatttctatggcagatggtttgaagaaagccaatcgattttagaacggcatcaatttctcaagcgaacggagaacggacatgttccaacacgctcaataggcaccatgagcgagctgtggaaagaatggaatgaacaaaaatctgacctgcttcaagacaataatatgaaagccatggtgacattggtggagacagcacttaaagccttgccggagattctgaccggcaaggcgtcagccaccgatatcctgtttccgaattcatctatggatttagtagaaggggtctataaaaacaatcaagtcgcagactattttaatgatgtgcttgcagatacgttaacagcctatctgcaagaacgtctgaagcaagagcctgaggcgaagattcgaatattagaaatcggagctgggaccggcgggacaagcgcggctgtttttcaaaaattgaaagcatggcagacacatataaaagaatattgttatacagatctgtctaaagcttttctaatgcatgcagaaaataagtatggtcctgacaatccatatttgacatataaacggtttaatgtcgaggagccggcgtctgaacagcatattgatgcgggaggctacgacgcggtcatcgcggcaaatgtgcttcatgccacaaaaaatatccggcagacattgcgaaatgcgaaagcagttttgaaaaagaacgggctgctccttttaaatgaaataagtaatcataatatatattcgcatttgacgttcggccttttagagggctggtggctgtatgaggaccctgatctccgcataccgggctgtccgggcctgtatccggatacttggaaaacggtgcttgagagtgaaggatttcgctatgtttcctttatggctgaacaatcgcatcagctcggccagcagatcattgccgctgaaagtaacggagtcgtccgtcaaaagaagagaacgggggcagaagaagatccaagccatatacaaatgaatgctgaaatcgctcattcacaggaaagcgattctctcatcgaacaaacggcacaatttgtgaagcatacgctggcaaaatcaatcaaactatcaccagaacgtattcacgaagatacgacatttgagaagtatggaattgattcaattttacaggtgaatttcattcgtgaattagaaaaagtgacgggagagcttccaaaaaccattttatttgaacataacaacacaaaagaactcgtcgaatatttagtaaaggggcatgaaaataagctccggacagcattgttaaaggaaaaaccgaagcctgcaaaaaatgaagctcctcttcaaacagagcgtacagatcctaataagccatttacttttcatacacgccgctttgttacagagcaggaagtcacggaaactcagctagcaaataccgaaccactaaaaaaagaaaagacaagtaatttgcaaggaacacattttaatgattctagtacagaagatatcgcaataatcggggtaagcgggcgctatccgatgtctaacagtttagaagagctttgggggcatttaatcgccggagacaattgtattacagaggcaccggaatccagatggcgcacatctttattgaaaacattatcaaaagatccaaaaaagccggcaaataagaaacgctatggcggatttttacaagatatagaggcatttgaccatcagctttttgaggtggaggaaaatcgggtgatggaaatgacaccggaactccgtttatgtttagaaaccgtctgggaaacgtttgaggacggcggctatacgcgaacccggctggataaattgcgggatgatgacggagtaggtgtttttatagggaatatgtataaccagtatttttggaatatcccatctttagagcaggcagtcctcagctcaaatgggggagactggcacattgcaaatcgcgtttcccacttttttaacctgaccggaccgagtatcgctgtcagctcagcatgctctagttcattaaacgccatacatcttgcgtgtgaaagcctgaaattgaaaaactgctcaatggcgattgctggaggcgtcaatttaacactcgatctctctaaatatgattctttggagcgtgccaatctgctgggaagcggcaatcaaagcaaaagttttggcacaggaaacgggcttattcccggggaaggcattggagctgtcctgttaaaaccactttcgaaggcgatggaagatcaggatcatatttacgctgtgatcaaaagcagttttgccaaccatagcggcggaagacagatgtatacagctccggacccgaagcagcaagcaaagttaattgtcaagtcgattcagcagtcgggcattgatccagagactatcggctatattgaatcggcggcaaatggttcggcgctgggcgatcctattgaagtaattgccttaacaaacgcgtttcaacaatatacaaacaagaaacagttttgtgcgataggctctgtcaaatccaatctggggcatttagaggcggcttccggcatttctcagctgacaaaagtgctgctgcagatgaagaaagggaccctggtgccgacaattaacgcgctgcctgtcaatccaaatattaagctggagcacacggctttctatcttcaggaacaaacaaagccatggcatcgcttgaatgatcctgaaactggaaaacaattgcctcgcagaagcatgatcaattccttcggagcggggggagcctatgccaatcttattatagaagaatatatggagacggcccctgagaaagaacatatcgctctccgccagcaggaattcactgccgttttttcagccaaaacaaaatggagcctgcttagctatctagaaaatatgcaattgtttttagagaaggaagcttctctggatattgaacccgttgtacaggctttacacaggagaaaccataatttagagcatagggctgcatttacagtgacatcaactcaagagctgatcgaaaaactaaaggtgttccgaacatcaagagaaagctcactccagcaaggcatctatacatcattcgatttacagccatgtccggaatcagcatctaaggatagagaaataaacgcagcagagcaatgggcacaaggggcatcgattgcttttaaagaagctgatatagggaaccgaacaggctgggttcatctgcctcactatgcatttgaccataatacatcatttcatttcgatgtatcgtctatcaatgagaaatcgtcagatgttgaagacaatatcaatcagccggtcattcaagagcaattcacttatgatgagccttacgttcaaggacacgtcttcaacaatgaacgggtgcttgtcggtgccacatatggcagtctggccattgaagcattttttaacctgttccctgaggaaaacagcggccgtatcagcaaattaagttatatcagtccaattgtcatcaaacaaggcgagaccattgaacttcaggcaaagccgctgcaaaaagatcaagtcatagaactgcaaatcatgtatcgcgagccgtcctctggtttgtggaagcctgccgcaatcggacaatgcggaatcggttcttttgagcccaaaaaagtcaatatcgagaacgttaagcattcattaactaagcttcatcacatcgatcagatgtataaaaccggaaacggtcctgaatggggagagttatttaagacaattactcatctctacagagatcacaagtctatactggcaaaaattcgcctgccccaaagcgggctggcaaacgggcaccattacactgtaagcccattgatgacaaacagcgcgtacttggctatcctcagtttcttagagcagtttgacatgacaggcggcttcctgccgtttggaatcaatgatatccagtttacaaagcaaacgataaaaggggattgctggcttttgattacattggttaagaatacaggtgacatgttgctgtttgatgtagatgtgatcaatgagtcgtcagaaacagtgctgcactactcgggctactcgcttaaacagcttcgtatttcgaatcaaagaggaaatgaaaataaggccatcaaagccagcgatctgaaagctcgtatcagaagctatgtaacagataaactggcagtaaacatggccgatccgtcaaaattgtctcttgcaaaagcgcatatcatggattttggaatcgattcttctcaattggttgcactgacaagggagatggaagcagagacaaagatcgaattaaatccgactctgttttttgagtatccgactattcaagagctaatcgacttttttgcggacaaacatgaagcatcttttgctcagctgtttggtgaagctcatcagcaggaagaacgcctagctcaaatcgaaaaccaaatgaaacagattccggcatacgagacgaacacggataaaacaatcgaacacgcggcagacggcatagccattatcggcatgtcgggacagtttccgaaagcaaacagtgtaacggaattttgggataaccttgtccaaggaaagaactgtgtctctgaagtgccgaaagaacgctgggactggcgcaaatatgccgcagccgataaggaagggcaatcaagccttcaatggggcggttttatagaaggaataggtgagtttgatcccctgttttttggcatatcgcctaaagaagcggcgaatatggacccacaggagtttctgctcttgatacatgcatggaaggcgatggaagatgcaggcttaacagggcaggttttatccagccgcccgacaggagtatttgtcgcagccggcaatacggatacagctgtggttccttccctaattccaaaccgtatatcctatgcacttgatgtaaaagggccaagtgaatattatgaagctgcctgttcctcagctctagtggctttgcacagagctatacaatccattcgaaacggcgaatgtgagcaagccattgtcggggctgtgaatttgctgctttcaccaaaaggctttattggcttcgactcaatgggctatttgagtgagaaaggacaggccaaatcctttcaagcagatgcaaatggctttgtcagaagtgaaggagcaggagttctcatcattaaaccattgcaaaaagccattgaagattctgatcatatttattcggttattaaaggttcaggtgtatcgcatggcggcaggggaatgtcacttcacgcgccaaatccggccggcatgaaggatgcaatgctgaaggcttatcaaggagcgcaaattgatcccaaaacggtgacctatatagaagcgcatgggatcgcctctccattggcagacgcgatagaaatagaggcgttaaagtcaggctgcagtcagctcgaattggaacttccacaggaagtacgggaggaagcgccatgttatatcagcagcttaaagccgagcatcggacacggtgaactcgtctcaggcatggctgctcttatgaaggtcagcatggcgatgaagcatcaaacaataccaggcatatccggattttcgtctttgaatgaccaggtgtcattaaagggcacccgtttccgagtgactgccgagaatcagcaatggagggatttaagtgacgatgcaggcaaaaaaattccgcgcagagcgagtatcaacagctatagctttggaggcgtaaatgcgcacgtcattttagaagaatatattcctttaccaaaaccaccggttagtatgagtgagaatggtgcccacattgtagttctttctgcaaagaatcaagacaggctaaaagcaattgttcaacagcagcttgactatctgaataaacaacaagaactgtcattacaagattatgcttatacactccaaaccggccgagaggaaatggaagaccgcctggcgctcgtcgtccgcagtaaagaagaactggtaatcggcttgcaagcctgcttagctgcggaaaaaggcgataagccgaagagttctgtacctgtctttagcggaaatgcagaaaatggctcgtcagatctcgaagccttgctggatggtccattaagagaaatggtgatcgagactttgttgtctgaaaacaaccttgaaaagatcgcgttttgctggacaaaaggggtgcaaatcccatgggagaagctttatcaaggaaaaggtgcccgcagaataccgttgccaacctatccatttgaaaagagaagctgctggaacggctttcaagcagtagagaatacgccttctgtttcacaggatgagcgtatcaacaacagcagcgatcatcacatattagcaaatgtactagggatggttccgggtgaactgcagcctcataagccattgcagcagtatggatttgattcaatttcttgcatacagttattacagcaattgcaatcaaaggtggaccctctcattgccttgacggagcttcaagcatgccatactgttcaggacatgatggacttgatcgcaaagaaaaaggaggatacatccttacaaaatgatcaagctcgcacgtttccggaattaataccgttaaatgacggcaagcgggggcgccctgtcttttggttccatggcggagtaggaggagttgaaatctatcagcaatttgcacaaaagagccagcgccctttttacggcattcaagccagaggattcatgactgattatgctcctttgcacggaattgaacaaatggcttcctattatatagagatcattcgatccatacagcctgaaggtccttatgatgtaggcggatattccttaggcgggatgattgcatatgaagtcacacgccagctgcaaagccaaggccttgctgtcaaaagcatggtgatgattgactccccatatcgttctgagacaaaagagaatgaggcatctatgaaaacgtcaatgctgcaaacaattaatacgatgctggcatcgattgcgaaacgggaaaagcttacggatgttctcatcagccgtgaagaggtggacataagcttagaggatgaagaattcctggctgagttgattgacttggcaaaagaacgagggctaaacaaaccagataagcaaatacgtgcgcaggctcagcaaatgatgaaaacacagcgcgcctatgatttggagtcgtacactgttaagcctctccctgatcctgagacggtaaaatgttattatttccgcaacaaaagcaggtctttctttggtgatttagacacttatttcactttatcaaatgaaaaagaaccgtttgatcaagctgcctattgggaggaatgggagcggcaaattcctcatttccacctggtggatgtcgattcaagcaaccacttcatgatattaaccgaaccgaaagcgtcaacagccatgttagaattttgcgaaaagctctattcaaacaggggagtagtgaatgcgaatttccttaaggctttccggaagaaacatgaagcgagggaagaaaaagaaacagatgaattggtgaagcgctgagaaaacacaaacgccccctcttttaaaagggggcgttttgaatgttattttgaaagtgaaacagggagactttctaatcctcttaaaaagacattttttctccattgaatgtcatcaggtgcaaccgcaagttcaatatcaggaaatctcttcaaaagtgcgttaaatgcaatgtggccttccagcctggcaagaggcgctcctaagcagaaatgaatgccaaaaccgaaagaaatatgtctgttaggcgaccggtttatatttaatatttcggggttctcaaaaaaattcgggtcgcgattggcagatccgatccctataaaaatcatgtctcctcttttgatcgaatgccccttatatgtaaagtcttcgatggcccaccgatttgccatcataacgacaggtgaggtgtatcgcagcaattcttcaaccgctgtagcgatcatttcaggctgctgcttgagcttctcacattccttcttgtgctgcagcaatgcgagggtgcctgagccgagtaagttaacagttgtttcaaggccggctacaacgagcaagaacagcatcgaatagagctctttttcgcttaacttgctgccgttttcctcagcatgcacaagtttgctgattaaatcgtcttttggctttattcttctgtcatggatcagcttggcgatataatctttaaattcacgaagagcctgatttgtcagctctctattaccttcagaggtatcaaccatcgcattggtccagatttgaaactgtgaccgatcttcttttgggattcccatcaattcagatataacaataaaaggcaaaggggaagcgaaggatttcatgatatccgctttattttctttttccatttcatctaaaagctgttcagcaatttgttcaatgctgccgcgcagattttcaatggttcggggagtaaatgcttgatgaacaagtgatctcaggcgggtatggtcaggtgtgtcttttgccagcatatgatcggatacaaaatcgatatcttcactaacgttgagcattttgatttgttcttggttcatcacattttttacgtctcttgtaattcgattgtcttttaaaaaggccatacaatcatcgtatcgggtaattaaccaggccggatatgtggctccgaaccgttttaattcaaatcggtgaatgggctcttcctctctaaatcgtcctaaaactgaaaaaggattgtgatgaaactctttaccatgcggatgaaacatcaatttttccatttgcattctcctcgcctaatagggtaaatagatgaatcaaattgctgaattagtttacaaaaaacagaatgatttgaaatgtaatcctgtctctaaaactatatatctatcttaggcgtcattcaatagggagaagaacgaaaaaagtgaaaaaacggctcgatataaagcagcgcctttgaacgaaagctcaaaggcgctacgctgtattattttgatgaaagtggctgtcagctgtgctggatatcaattgtatatactgcacgatctgttacgaccttcaatccttcgttttcttggtgaatatgaagctcacctaataaaggaatctcataggcattttgcggaagcggtacgtttccgtcctcagtgaatgttgttccttcgccttctaaaacaagctcttctttcgcaacataatcatcaggatgattcgtactgcgtatagccactttttgaaggtggagaacaatctgatccaagtctgatatctcttcatcatgggtcaattcaccttttctaatatcaagcgtctggccgacttttgattccagccattgagaaagctgtgtattcgtgtgtgccatcaatattcctccttttgatctacacgatactattcccaattgctgcatcttttacacgggaaagagccgccccactctttatgtatgaaacagttcgctgttgagtgccttgatatagcgtacggcagaacgctggaccgattcgtcggcattttctttgacaactttagagaaagcattgtaaagccggttgaattgaagcggttttactttggctgctatttcttcaactttggaggcgggaaggggaatgagatttgggtagctgtacataaagctgacccagtttcgatccgccgcaaccgtaatgatatctccggtcaatagacagcctttcccttcattgcccttgctccaatgcaaaacagcaccgcctttaaaatgtccgcccagtcggtaaaggtccagtcccggcttcatattgagcgtttcccctgaccagaagtgaatgtgattgcttggccttgtcacccattctttatcatcctcatggatatagatcggcgcctgaaacgcttcagcccactcaacctgagtagagtaataatgtggatgagacaaggcgatggcttgaataccgcctaattcgttgatttggtcaattgtcttttggtcaagatatgtcatgcaatcccacagcacattgaagcccttatgctggataagatgggctgtttgtccgatcgcaaactctggttcagttttgatgctgtaaagatgctcttcttcctttttaaggatgttttgaaggtttcctttctcacgcatgtcttcaagggttgtccaagtttgtccatcgggatgaatatactgtctttcatcctcgcaaatcagacacgagttgggcggatctactgtctgtgcatgttgcacaccgcatgtgttgcagatataataaggcactttcttcacttccttcatctattttccattattttaccttatgattatgaatattcaaacaaaaggccggcagttctgctgagagagaattgccggcttttgatgatgtttattggccgggaacggaattttctgcgttgacagcgcccgctccgtagatattcggatcttcatctttccatttgtccgtgccgtttttcaaaagctcttttacttcatcaggggtaagatccgggttttgctgaagaattaaagctgcgattcctgcgcaaatcggtgttgccatcgaggttcctgacattgtaaagtactgagaccctacacggcttgacttttggagcttatcaatataagaattcggagagcgaagggaaataatattaacacccggcgctaaaatatcaggcttttctttcccatatactgtcgggccgcggcttgagaaggaagcgacagtatcatcatcgctgcttgcagtattgttatcgtcaagcgcacctactgtaatcaccttttcgctcacgcccgggcttgcaatggtctgcgaatcagggcctgagtttccggcagcgacacagacgacaatccctgcgctccacgcttcctcaaccgctctgactaacggatcttcctgttcatgatcatatctaagggcatcgcccccgagcgacatgctaataatatcaatcggttcatcggggttgtcctcattgtattgaatacaccactcaacaccctctataatatctgctaacgttcctgaaccctgcttgtttaatacctttacgccaatgagattggcttccggtgcagggccgcggtattgaccggaagaggatgcgccgctgcttgcgacatcacctgcacagtgtgtgccatgaccattatcatcgtacggctctgttttttgattgaccatgtccgcgaatccgataattctgccttctagatcaggatgcgggtagattcctgtatcgacaacagcgacagtaacaccttttcctgtcagggtttgaccgtttctgacgacttccttcgcatggcttgcttcggttgccgtgtctaaaagcgctttgacttcgcggtttaaatacactttacggatattgctgcattcagagagaagggaatgtaatgctgaaggagtaacttcggcgctgcagcagttgattttgttgaagcggctttttagcttgctgcgtttttctttttgcagcacctctccagctatttgaaggccggtctcgtgacagccttcctcaaattcgataatgactgacattttttttctgttttgcaatttggtttcgaaaaatttatgcaagaagcaaggagtccatttgaagggcttgtaaagctgcaatacggtttcccgtaacggccaatctagcttgtgagcatttgctctcaccatttgtaccatagagtacccaaacatgtattttcctcctattataaggttctctgtatactctatgaacagatgataggtttggtaagtttgtttgtcctctgtaagagacagacaagagtttgtttttctgaatctttcgcattagatacgatagattcagaagctgaggaaatcattggggattgaaaaagaacgtttgttcgtattataatgtgatcatatcaaactgggaaggggagagcaaccgtatgaatttctacttgcaccgatctttggaaagccaaatgccaatcagcattatatatatgaagaaagacggaacgattagtaaaagaacgattattgtgagacagaaaagcaaaacgaaaatcaaagcattttgtttttcgaaacaacaaatcagaacatttttattggactctatcctctcctgtgactttgtgagaacaaataagcaaaatctctattctgcaggccggtaacagctgtccgtctcagcaaccgggcagcctgttactaaaaccctccttaaacctatatacatttatttgccaagtgaggttgttcctaccttttttgtctttcctctcaaccttttttcactcttatttgaaatgaaccgctaataaccgtgacaatcaattgattttttgaaaccgggaactttttcactgatgatattgtgtatacaatggtaagataaaacctattggctaaacctcatataatgaaccgcgccattcttatgaaaggagttaaacatgagaagatttttactaaatgtcatattagtcttagccattgtcttgttcttgagatatgttcattactcattggaaccagaaccatcaaatcagccagatacatattcaaatttcagcagcttggcagagaatgagagcccagccgattacgatatttcatataatgagaaaaaaggaagcaaagtcttaattatgtctccgcatggcggaagaattgaaggcggagtaagtgagcttgtgcgttatttcaataatgaatactctacatacctatttgaagggttgaagtcccatgataaccaaacactgcacattacaagcaccaactttgatgagccattggcaaaaaagaaaatcaaggagcatcaatatgtggtggcttttcacggatataaaggagagaacaagaatacccttgtagggggaacagaccgaaagcgggcgaaaatgattgtgagagcccttgagcggagagggttttccgctgagttagcgtcgtctaaaagcggtcttgctggattgaatgccgaaaacattaataaccaaggggaaacggggctaagtatccagctggaaatcagccgtgagcagagagaagcattttttgatgatttttattataaaaatagaaaatacacaaagaacagtgaattttatgcttatgtcagtgcgatcaaaggtgtcctggaaaaagagtattcgtaacaagcagatcagaagacaaaataagagaagatcagtagactgaaataggataaaaaaggaggcaaaacaatggcagatcatcatttttatttaaaagcgaactggccgggtaaccgtaatgatgtcggtacgatcgaaagcggaaacctgatcacatcgatttccattcctaaagaaatggatggcccgggagaagggaccaacccagatgaaatgcttctcggggcggcagcgacctgttacattattacacttgcagcgatgatggagagaagcgggctggaaaaagaagacttacagatggagtcagaaggcattgtcaacgttacaaaaggagtctttacatacaaaaagatcattcaccgtccctctgtcgtgcttaaacatgatgcttcacaagacgacgtcgcattggcgcacaaactttgtaaaaaagcggagtcgtcatgcatgatttcgcgtgcaattcaaggaaatgtcgagctgcagcttgaagcctctgtgaaactgggttgagaataaagaaaacagacggtcactcacaggccgtctgttttttatcttcagcgtgggctttcgattgatttagcacgaccacgcctgcaatgacaagcgtgagaccgaatacaccttttaaactgatggtttcgccaaaaagcaaaaacccgacaattgctgtaagcgcggtaccaacgcccgaccatgttgcatacgcgcttgataagtcaattgtttttaaagaaaagcttagaaacgtaaaagcagaaagaaatccgactatgactccggcaatgggccaggcttgtgtaaatccttctgaaagcttcaacatcgtgctcccaaacacttcagatacaatggcgagagccaaataaagcaatcctctcatcttcatcactcctttacggccaattaagtaacacgacccctgatagtaataaaagaatcccgataagccctttggcattcagatcttccttgaaccattttactccgatcactgtcgtcagcaccgtgcctgccccgctccaagtcgcataggagaggctcaggggaatatggtttaaagtcagggacagcatataaaaggcgagggaatagccaataacgaccaaagcacttggcttccactttttgaagccatcagatactttcagcatggctgctcctatcgattccgaacatatggcaatcgtgaggaatatatatcctatcaacatcatgaattctcctcactatatttttagattagaaaaaaacttcagctagaaaaatattagtgtatgcctatgtatgagtcaagagattcattttcacacacttaaaaagacccctttttaaggggccttttgcgtttaataataataagggaacggggcatacggataataggggtatccgccatacaaataaggattaaataaagcgcttcctataagcccgcctgcaaggccgccgataaacggtcctccaaaaaatccgaatggccggccaaacccataaccaaatccgggtcttccaaatccgtaaccgaacccgaacggtcttccaaacccaaatggtctcccgaatccgaacggtcttccaaatattcttgtatcttcagggctgaaatgctctaactcgttcatgttttctttcctcctgtaataaagtgtagatgatgcagtgtattcaccctgcccggatttgattgggcgaatcgaggaaaaggaggatgtgaacacattgggcctgtatcagtctgactggtcaaaagcaccgccccacgcacatgcctatcatgtcaaaacaacgagagaacagggccattatcatctcattgaagggtttactcagccggcaaacggatcaaataccgatcagcatacacattactatacagggatcacttcatttgaaaacggccattttcatcggtattacggaatctcagggccggcgattcccttagcagatggcacacattatcatgaaatcgaagaaacgacatatctggcctataacgagccaattgagatccagtacggaggggttgtgtacgatcccggagatgacagaagaaaaacgcatcgtcataccctgaaaggaaagacaagggaaattgtcggcaatgagccgctcggctggtagaaggatgtttaccgatgcaaaaaaagggcaaaatggataggtggttgtccatgttgaatgctataatgggggggagatttataaaagagagtgatacatattgaataatacgaagcagcccgttgtcattttagtcggaccgacggcagtggggaaaaccaatttaagtattcaactagccaaatccttaaacgcggaaattatcagcggagattcgatgcagatttataaagggatggatattggaacagctaaaattaccgaacaggagatggagggagtgccccatcatctgattgacattttagatcccaaagactctttctctactgccgattatcaaagcttagtaagaaataaaatcagcgagattgcaaatagaggaaagcttccgatgattgtcggcggtacagggctttatatacaatctgtgctttacgattatacatttacggaagaggcaaatgatcccgtgtttcgagagagcatgcaaatggccgctgagcgggaaggcgctgactttctgcatgccaaacttgctgcagcagatcccgaggcagcagctgcgattcatccgaataatacaagaagagtcattcgcgcactggaaattttacatacgtccggaaaaacgatgtcccagcatttgaaggaacaaaaacgagaacttctgtacaatgcagtgttaattggcttgacaatggatagagacacgctttacgaaagaattaatcagcgggtcgatttgatgatggagtcaggccttcttccggaagtgaaacgcttatacgacaagaacgtgagagactgtcaatcaatacaggcgataggctataaagagctgtatgcatattttgacggttttgtgacactttccgatgctgtcgaacagctaaagcagaactcgaggcggtatgcgaaacgccagctgacgtggtttcgcaacaaaatgcaggtcacatggttcgatatgacaccgcctgttgatatggagctgaaaaaaaaggaaattttcacacatatagcaggaaaactcgaactttaatcgaaactgtatgatatagagaatcaaggaggacgaaacatgaaaccgattaatattcaggatcagtttttgaatcaaatccggaaagaaaatacgtatgtcactgtttttttgctgaacggctttcagttgcggggccaggtgaaaggctttgataactttaccgtattgttggaatcggaaggtaagcagcagcttatatataaacatgcgatctcaacgtttgcgccgcaaaaaaacgtccagcttgaactcgaatagatcaaaaaatgccatgtcaagacatgaggaaaggctgccgggggttcccggcggccatttttaacatgaatccacttttgctccaagctttttgtgtaagctgaccatgccaaggcacggtctttttttatgagaacaacatacggaagtgaaaatggtatattatgtataaaatgaatttgggagtgatcgaccttgtttgaaagtgaagcagaactgagacgaatcaggattgcacttgtatggatagctgtctttttactgttcggggcgtgcgggaatcaagataccattattgaaacagacagcggcaattcagactatgaaacgcctcagcccacctcgtttccacttgaacataaccattttggcgttatggaggacggctatatcaaaatttatgagtataatgagtcccgcaatgaggtaaagctgaagaaagaatacgcggatgatgagcttgaataaaattcacaagcattcgaatttacaaagcggattccagccgctaaactaaatacagacacagatcaaacagagggtgaaaacatgaagcataaagtgatcgtgaatcattgggaagaaatttgcgaagatgattcttgctatgaatacggaacaagtatcattgtgaacggaaaagaattaatcagagaagcgtcaattatcactgctttgaaggcggttttagaagagatcggcgcggatgttgaaatagaagaaacagtagagagcgaaaaatgctgtgatagcttaagaaaaaaaaatctagactactaagcagttttttttcatgttatgataaacatcggctaaaaaacgacaccccgagtaggatgagagatgattctcgttctgctctcttttttgggccctaatgagtctgcccatttgcctgatttgatcaaaatatgaatttttcataaaaacgaatctatatattgtgtttttgctagagggtagtatactgtatatagtgttagtgatgagagattcatattttttgataggtcgtgataaaacgtggtacaaatcatatttgattcgaaaacagggaatgttcagcggtttgtgaataaaacaggctttcagcagatacgcaaggtggacgaaatggaccacgtggacactccgtttgttttggtcacctacacgacaaacttcggccaggtaccggcatcaacacaatcatttctcgaaaaatacgcccatctcttattaggagtcgctgcgagcggcaacaaagtatggggcgataactttgcaaaaagcgccgataccatttcaagacaatatcaggtgccgatcttgcacaaatttgaactcagcggcacatctaaagacgttgaattgtttactcaggaggtagaaagagttgtcacaaaatcaagtgccaaaatggatccagttaaataacgaaatcatgatccaaaaagatggaaaattccagtttgataaggataaagaggctgtacatagctattttgtagattatatcaatcaaaacacagtcttctttcacgatttaaaagagaagctggattatttggttgaaaaccaatactacgaagaggaattcttaagcctttattcttttgaagacattaaagaagtgtttaagacagcttacgctaagaagtttcgttttccttccttcatgagtgcgtttaaattctataatgactatgctttgaaaacgaatgacaagaaaaaaatcctcgagcgttatgaggaccggatctcaattgttgcgctgttcttcgctaacggcgacactgagaaagcaaaagaatatgtaaacctgatgatcaatcaagaatatcagccgagcacaccgacatttctgaacgccggcagaaaacgccgcggtgaacttgtgagctgcttcttgctggaagtcaatgattccttaaatgacatttcaagagcgatcgatatctccatgcagctttctaagcttggcggcggggtttctcttaacctgtccaagcttcgcgcgaaaggtgaagccattaaagatgttgaaaatgctacaaaaggcgttgtaggcgtcatgaagcttcttgataacgcgttccgttatgctgaccaaatgggacaaagacaaggctctggcgcggcgtacttaaatattttccaccgcgatatcaatgattttctcgatacgaaaaagatttcagcggatgaagatgtgcgcgtcaaaacgctttcgatcggtgttgtcattccggataagttcgttgagcttgcacgcgaggacaaagcggcttatgtattctatccgcacacgatttataaagagtacggccagcacatggatgagatggacatgaacgaaatgtacgacaaatttgtcgacaaccctcgggtgaaaaaggaaaaaatcaacccgcggaaattgcttgaaaaactggcgatgcttcgttctgaatcaggctatccatacatcatgttccaagataacgtgaataaagtgcatgcgaataaccatatttccaaggtgaaattttctaacctttgctctgaagtgctgcaggcatctcaagtttcttcatacacagactatgatgaagaagatgaaatcggtctggatatttcctgcaacctgggttcgcttaacattctcaatgtcatggagcataaatcaatcgaaaagacagtcaagcttgcgacagactctttaacacacgtgtctgaaacaactgacatccgtaatgcgcctgctgtaagacgggcaaacaaagcgatgaaatcaatcggcctcggtgctatgaaccttcacggctaccttgcgcaaaacggcattgcgtatgaaagtccggaagcgcgtgactttgcaaacacgttctttatgatggtgaacttctactccatccagcgttctgcggaaatcgcaaaagagaagggtgaaacgtttgatcaatatgaaggctcaacctatgcgacaggtgaatactttgacaaatacgtttctactgatttctcaccgaaatatgaaaaaatcgctaatctgtttgagggtatgcatatcccgacgacagaggactggaaaaagctaaaagcatttgtggctgaacacggtatgtatcacagctacagattatgcattgcgccgacaggctctatctcatacgtccaatcaagtacggcgtctgttatgccgattatggaacgcattgaagaacgaacatacggcaactcaaaaacgtactacccaatgcctgggcttgcatctaataactggttcttctataaagaagcctacgatatggacatgttcaaggttgtggatatgatcgccactatccagcagcacattgatcagggaatcagctttacattgttcttaaaagacacaatgacgacccgtgatttaaaccgaatcgatctgtatgcacatcatagaggtattaaaaccatttactatgcaagaacgaaagatactgggcaagacagctgcctttcttgtgttgtttgattaaaggagagtttatagtgacaaaaatttatgacgcagcaaactggtcaaagcatgaagacgattttacccaaatgttctataaccaaaacgtgaaacagttctggcttccggaagagattgctttaaacggcgatctcctcacatggaagtacctcggaaaaaatgagcaggacacttatatgaaggtactggccggacttacgcttcttgacacagagcaggggaatacggggatgccgatcgtggctgaacacgtagacggccaccagcggaaagcggtgctgaactttatggcgatgatggagaacgctgtccatgcgaagtcgtactctaatattttcatgacccttgcaccgactgaaacgattaatgaagtatttgaatgggttaaacaaaataaatatttgcagaaaaaagcgcaaatgattgtcgggctttacaaagccattcaaaaagatgatgaaatttcactgttcaaagcgatggttgcttccgtctatctggaaagtttccttttctacagcggtttctattatccgttatatttctacggacaaggaaaactgatgcaaagcggtgagatcattaacctgatccttcgtgacgaagcgattcacggcgtgtatgtcggtctccttgctcaggaaatttataataaacagacagaagagaaaaaagcagagcttcgtgaatttgcgatcgaccttctgaatcagttatatgaaaatgagcttgagtatacagaggacttgtacgatcaagtcggactctcacacgatgtaaagaaattcatccgctataatgcgaataaagcgctgatgaatcttggatttgatccatacttcgaagaggaagatattaatccgatcgttttaaacggattaaacacaaaaacaaaatcacatgacttcttctctatgaaggggaatggttataaaaaagcgacagttgagccgctcaaagatgatgacttttattttgaagatgaaaaagagcagatataatatctgctcttttcggcttgaaggttcaaatgaggaggacgcagtacccatgggaaaaatggacgaaatgattttagttgccccacgcgatgatgtgtttaaaaaagaaagcttaaccttccagggcgtgtacagtgaagatagcagagtagccgaaatcatggctcagattgaagcggcctatcgtgaaatgagaagaggggacgcagaagaagatccgcgtttcaagcagccgataccttatgtcgtcattaagcgtgaagatgaagtttttctttacgagcggctggctggcggcggtgaatcacgactgcacaacaagctttctctcggctttggcggtcatatgaacgccatcgaaggggcagcttcatttgctgaagtcttaaagctgaacacagaccgtgagcttgaggaagaactgcaaataaatgaagaagataaacaggcgattgtcacactgggattgatcaatgatgatgaaaatagtgttggcaaagtgcatatcggtattctttctgcgcttcaattaaagcctggcgcacaagtggaagtgaaggagaaagaacaaattgcgggtaaatggatgaaagtttctgaattaaaacaggatgacatctacaaccgtctggaaacatggtcacagtttgttgttgatattcttgaataaaaaaacccggtttctcgcgatgaggagccgggtttttttatgagacgctcgtccccgtctcggctatgattctaggatcacaatagcgtcaaagccggcatttttcgctctggcagcgagagtgtctgcattgtcattggatgaaaatgcgccaatctgcactttgtaaaatccgtcctttaaaaggacaatcgagtcaaaacctttggcttcggcattacttgcgagcgagtcggcattcgctttggctttaaatgcgccgatttgaaccttatataaccctgagctggaagtctttttaaggttaaaggcttgctccagcccgtttgcatgtcctctcgctaagctttgaataaaactgctcgttttcagcttatttgcatcggaaacggtatcaatgaagccgttctcggtcaagagggcaggcattgccgactcccttaggacgtggaagttcgctgtttttttgccgcgatcggcaaagtcgacagcttgtatcacttcagagtgaattgccgattgataagtcgtcgtcggggctcctacatctggataaatatagctttcaaaacctgtgcctcccccggaattaacgtgaatggacaaaaagaaatctgctccccagttatttgcggcatttgtccggtcgtttaagctgacatattggtcgcttgtccggctcagcagcagagaaacgccttcatattcattagttaatatcgtacgtaaggctaaagcgatttgcagggttaacgttttttcctgaaggccattacctgttgcgcctggatcagacccgccatggccaggatcaataaaaattttaaccatttttcatcacctcattacaggatatgaaaaaacacagcttctgcttgtacgattatcattcaactgaaaaatgaggaaataaccctttcacatccagaaattatttctcgggaaagcgcacaattcaacatgaagcgacaacagatacggtccgacatgaaatctgtgcatacgccatatgtttgtatgtactttgagttcggttaacctgcactgattcctgttggttttaagctttgcgttcatattaaatcaagcatttgaaacgtaaattgatgagaaaagctcctttcattaaagacaccactttataaatcgaaaaaaagaaaaacacttcaggtatcttagggcgggtaatacgcttcgtacaaaaaacagcccgttgcatgaaaaaaggattggcgaatggagaaaataatgagaaagaagctcactataatactttgacaaaatgattaaaaacaaaatctcatggtttgtccaccccatgtccgtgaatacaataagaaataaagtatttctcgggaaagcgcaggattccttattgttcccgaaaaaagcaattgtttcgacacatgataggcgtttgtcacaatcggcatccgcttgaatatcatatagagagaacagagaggtgaagatgttggagcgcgctgtgacttataaaaacaacggacagatcaacattattctgaacgggcaaaagcaggtgctgacgaatgctgaggcagaggcggaatatcaggctgcattgcaaaaaaacgaagcaaagcacggcattttgaaggaaatcgaaaaagagatgagcgcattagttgggatggaggaaatgaaacgcaacatcaaggaaatatacgcctggatttttgtgaaccaaaaacgcgcggagcaaggcttgaaggttggaaagcaagcgctgcacatgatgtttaaaggaaatccgggaacgggaaaaacgacggttgcacggctcatcggcaagctgttctttgaaatgaatgtcctgtcaaaaggccacttaatagaagcggagcgggctgacctggtcggggagtatatcggacacaccgcccaaaagacgagagatttaatcaaaaagtcattaggtggcattttgtttatagacgaagcctactcgctggcaagaggcggcgaaaaggactttgggaaagaagcgatcgacacacttgtaaagcatatggaagacaaacagcatgagtttattttgatactcgctggatattcacgggaaatggatcattttctctcgttaaatcccggtctccattcaagatttcccatctccattgattttccggattactctgtgacccagctcatggagattgcgaaacgaatgatcgatgaaagggaataccagctcagtcaagaagcggaatggaaattgaaagattacttaatgacagtgaaaagcacgacaagccccattaaattcagcaatggacgttttgtcagaaatgtgatcgaaaaatcgatcagagcacaagccatgaggcttttaatgggagaccaatacttaaaaagcgacttgatgaccatcaaaagccaagatctttccattaaagaagaagcatctggatctgcatagacctctcagtttttgagaggtctgttttttgctcgtatttccgcttttcaaagcaatcgatttgtggtatacacatgcagggtttggtatgataatactactgcccaatatgcaaaagaaaggaacatccatttgaacgaacaagaaacgattcaggagaaagccattttagtcggatgtcagctgccgcatatcacggatgagcattttgaaaattctatggaagagctagcatctctgacgaaaacagcagacggaaaagtactgaccagcgtcacacaaaaacggaacagggctgacgccgctacatatataggaaaagggaaggtagaagagctgaaggcactggtggaagagcttgaagctgatctcctcatctttaatgatgaactgtcgccaagtcagctgaagtcattggcaacagcaattgaagtgaagatgattgaccgcacgcaattgatattagatatttttgcaaagcgggcgagaacgagagaaggcaaacttcaaattgagctggctcagctgcaatatgcactgccgcgtctgacgggacaagggatcaacctttcccggcaaggcggaggaattggggcaagaggtcccggggaaacgaaactggaaaccgaccgccgccatatcagaaatcgcattcatgaaatcaacacacagctttccactgtcattcgccatagaagccgataccgtgaaagaagaaagaaaaacggtgtgcttcaaattgcgcttgtcggctatacaaacgcagggaaatcaacatggttcaaccgcctgacgagtgctgacagctatgaagaagacctcctgtttgccacgctcgatccaatgaccagaaaaatggtcctgccaagcggctacagtgttcttctttcagatacagtaggatttattcaggatcttccgacgacattgattgctgcattccgctcaacgcttgaggaagtaaaagaagcggatttgatcctgcatttaattgattcttcaaatgaggattatgcgggacatgaaaaaacagtgcttgggcttctcgaggagcttgaagcagatgatatcccgatgctgacggcttacaataaacgtgatcaaaaactgcctgattttataccgtccgccggaagggatcacattatggtcagtgcgaaatttgaggacgacgctgcagcctttaaagaagcgattcagcgctatttgcgccaagaactgttaacgtcttttgaagcacatgtgccggcaagtgaagggaagctcctttccagaatcaaatcggaaacgatgatagaccgcttctattttaatgaagaaaatgaacagtatgacatatccggctatgtccaagaagagcaaagtatcatcggtgaattaaagaagtatatgtaggaaggaaaaataaagacatgtttgacacattaacacacggagaattattgaagaaaacggcaatggaagtggaagcggacattgccggcattcataaacaaatagaagaaatcagcgagcgaaatgagtggagagtgcttcaaagctatagaaaacacaaagtaagcgacactcatttcacgccgtctactggatacggctatgatgatatcggaagagacacgcttgaaagcatatatgcggatgtgtttggcggagaagcggggcttgtaaggccgcaaatcatttcaggcacacatgccatctcaattgctttgttcggtgtcctcagaccgggggacgagctcctttatatcacgggcaagccgtatgatacgctagaggaaattgtgggcgtcaggggtggagaaaacgctggttcgttaaaggattttcaaatcggctataatgcggttgatctgacgaaagacggaaagatagactatgatgcagtcgccgctgcgatcaatccgaagacaaaagtaatcggcattcagcgctcaaaaggatatgcgaatcgcccttctttcttaattagtgaaataaaagaaatgatccgttttgtaaaagaaatcaatgaaaatctgatcgtctttgtggacaactgttacggagaatttgtggaagagcttgagccttgccatgtcggagccgacctgatggcgggatctctcattaaaaatcccggcggcggccttgcgaaaacaggcggctacctcgtcggaaaagcgaaatggattgaagcttgctcataccgtatgacgtcacccggcatcggcagagaagcgggggcatctctttactcgctccaagaaatgtaccaaggcttctttttggcgcctcatgttgtgtctcaaagtctaaagggagcggtgtttacagcgagattccttgaaaaactcggcttcacttcaaacccgaaatgggatgcgaaaagaacggatttaatacaatccgttgagttttctgacagagaaaagatgattgctttttgccaggctattcaatttgcatcgccaatcaatgctcatgtgacgccttatccagcctacatgcctggatacgaggatgatgtcattatggcagcaggcacgtttattcaaggagcaagcatcgaattatcagctgatggccctatccgcccgccgtatgtagcgtatgttcagggaggattaacctattcgcatgtgaagaatgccatatgcagtgcagtggattcattgatggaaaagcaattaatttaaatttttaaaaatttctctggatttgatgttaagaatccttacatcgtattgacacataatataacatcacctataatgaaactaagttaagaaaaggaggaaattgagatgagtgataatattcgccgctcaatgcctttatttccaataggaattgtcatgcagttaactgagttatcagcaagacaaattcgatattatgaggaaaatggactgatatttccagccagaagtgaagggaatagacgattattttcatttcatgatgtagataaactgttagaaatcaagcacctgatagaacaaggtgtaaacatggcaggaattaaacaaattctggcgaaagccgaagccgagccagcacaaaaacaaaacgagaagacgaaaaaaccaatgaaacatgatctgtccgatgacgaactgagacagctcctgaaaaacgagctcatgcaagccggccgttttcaaagagggaatacattccgtcaaggcgacatgtcccgcttctttcattaatccgttagcaactgttttgctatatacatttaccttttaagaggaggaattttaccaaatggcaaagtacactagagaagatatcgaaaaattagtaaaagaagaaaacgtgaagtatatccgccttcaatttactgacattcttggaacaatcaagaatgttgagattcctgtaagccagcttggaaaagcgcttgataataaagtcatgtttgacggttcttctattgagggattcgttcgtatcgaggagtcagacatgtacctgtatccagatctaaatacatttgttatcttcccatggacagctgaaaaaggtaaagtagcacgtttcatctgtgatatttacaatccggatggcacaccttttgaaggtgacccgcgaaacaacttaaaacggattttgaaagaaatggaagacctcggatttagtgattttaaccttgggcctgagcctgaattcttcttattcaaattggacgaaaaaggcgagccgacgcttgaactaaacgacaaaggcgggtatttcgacttagctccaactgatttaggagaaaactgccgccgcgatatcgtgcttgagcttgaagagatgggctttgaaatcgaagcatctcaccacgaagtagcacctggtcagcacgaaattgactttaaatatgctggagcagtccgctcttgtgatgacatccaaacatttaaactagttgtcaaaacaattgcccgcaaacacggcctgcatgcgacatttatgccaaaaccattgttcggcgtgaacggttctggtatgcactgcaatctatcactcttcaaaaatggtgttaacgcattctttgatgaaagcgcagatcttcagttaagtgaaacagcgaaacacttcatcgcaggtatcgtgaagcacgcaacaagctttacagcagtaacaaacccgacagtaaactcttacaaacgtcttgttcctggctatgaagcaccttgctatgtagcatggagcgcgcaaaacagaagcccgcttatccgtatcccggcttctcgcggcatcagcacacgtgttgaagtacgcagcgtagacccagctgcaaacccataccttgcacttagcgtattgcttgctgcaggattagacggaatcaaaaacaaactggaagcgccggctccaatcgaccgcaacatctatgtgatgagcaaagaagagcgcatggaaaacggaatcgttgaccttccagcaacacttgcggaagcgctagaagaattcaaatcaaacgaagttatggtcaaagcgctgggcgagcacctattcgaacacttcatcgaagcaaaagaaatcgaatgggatatgttccgcacacaagttcatccttgggagcgcgaacagtatatgtctcagtattaatctctcaatcccttggcactaaaggtgtcaggggattttttatgttaataggtaataaattatggagcggcactgctaaaaagcagggtcacttttagtctatgtcactaataattctatgtactaaattttcaattagggaaataattccacgcttaaggaagcaatacgcataaataattcgacaaattctgtgataattccattgttcaatacttctaccagcaataataagatgagcaaggtggatgattatcattgacatcataaccaaaaaaatccataattacgttgaaatctaaatcaattttcaaaaaggagatttccatgaaaaaattgactatcttttccgggggattaggagtggttttttctgtactggctcaactgtttgcggttatagatgactcttacactttggggaatttatggtttttaggtgctttggcgggaattataaccatgcttgcttcaatccagacaaataataaaccaatcttcagcattttattaatttctagttcagtaataggtctacttggaactggttttgtatacatcataccaacactgttcaatataataataatttataaattttcaaaagtaagccaataagccaatgggaaaattaaggttctttttttatttaacatccctttgacaaggtcggtaatgaatcgcagaatgttgcaactggtccacacagttggggaaatcgtgggcatgattatcgaacgccatgtttctaggataccggaattgaaacatttgctgagtcatttcgtgaagttgatcaccaaatgtccatttcaatagaggcacgtctaaagaagctatcataggaggacaatactgtgtggaaagctttaagtcaattactcaagaaacagaaaaatcaaagtccaagcgatgagggttatatacagattccagaaaaggatataaatcaagaattaaagcaagtgatatttgagttggagagcctgggggaagtagtatcgaaaaagctgcagaataagtatgcaggtgtttttgaagctcaggataaaccaaatctcagcatcaaagtttgtagagacatagatggagatgtgctaaatgattttacagctgagagatgttttgaaaaagaataccgttcacaaatagcaattaattactatcaacctgcaatagtctgtgatgaagaattagcctgtttcacaatggatttgtggtattactacggtggatataaagggacgggttgtggaacattattcgatttaaataataatgacttagaaaaagaaattgaagagacgctaatatttttgctcaatgacaaacaattcgagaaataaaaaagaaggccgcaaagcgctttcaatcaactgatgtagctaagaaaagcgtttaagaattagctgacttgggtgacagcgagttttccgggaagggtgcagacaacattaaagcattttatcatgatcatgccggcattacagatcaatgtatcgatcggattgacatggaaattgctttcttaagcatcatttttgcaaaacttgtagatgcaaagatgtaagatacttacatagaagagtcatttttaaaacatgagctggctaacgattacacaaaatcaaaattcattatgtctgaacaaaagaaaacgatgaaagacattctgaataacaccattgaataaatatcttaaggataaaaaagtgaattggtcaaaggaattgaaatatttaaaagggctattaggctccaaaacgcttgcaaaagatttaaaaatccaaatgaatgtttaagtatttgttttcaggtttagtgataactatgtctatacttaaaattatatccatttgataatccagagagaaaaaccttaatgtcccgtttaataggggaaagaactatgatatctcctagtcaccaatatataagaaatgggacaagcaaagatttgttaggcgcaactttaattaaataaataaaatagcaatcttgtgataatagtagctaatctgttggtacccttgccagcagcttttataaaacgtttttttgactttgagttgctctttcttagtctgataaaacttcttcattagcgtccgcttctcaatctaggatatgtgaaatcctcaatcgcattgcaaattcccgaaaagctttttctgtctttaaatcaagtccaaacttcattctctcggccgtctaagaagctaatttactgcttcttcttttcaggttccatgtaccggtctttacagtgtctgggagaaaaagtgatttggggcattcatctttttttatttcagctagcgaagtgaaagaccgatggcatttttcctgcatataatagctggaactattcaaaaaggcagggaatgaagttgagtgaatgatgtgattgtaaatggaggttttgaaacaggcaatctgacgggctgggcttctgcaaatacgtccgttattaatacttttgcccattctggaagatattccgcacagtttttcagtaaccagccgtatgcttttttagggcagatcgtgcctgtcgtttctggacaatctctgatattcatcgtttcgcttgggagaattggaaacaattcaagtccccaagtaactatacaaattttatttgttaacagtgaaggcgaagagattgaaggcggacaggaaattatcattgcttccggaaatttgccaaatgtctcatttaatacatggaatgaaatatatagaacaattgaaacccccgctgaagcagtaaacgcagtggtggtaataagcaaaactacttttgggtctgttctaattgatgatgtttctttaatagagtctgctgggggaattggaccgactggaccaacaggtgcaacgggagcaacaggcgcaacaggcgcaacaggcgcaacgggagcaaccggagcaacaggcgcaaccggtccaactggagtaacgggagtaacaggggcaactggtgcaaccggatcaaccggatcaaccggatcaaccggagaaacaggatcaacgggagtaacaggggcaaccggagcaacaggagtgactggatcaactggcgcgaccggagcaaccggatcaacgggatcaaccggagaaacaggtccaacaggaccaaccggagaaactggagcaaccggaccaaccggatcaaccggagttactggagcaattggagccactggcgcaacaggatcaactggtgcaacgggagtaaccggagccactggagtaacaggattaactggaccaaccggagaaactggtgcgacgggagtaaccggagccactggagccactggagtaacaggattaactggtgcgacaggagaaactggaccaaccggagcaacgggatcaaccggagtaacaggtgtaacaggatcaactggagtaacaggatcaacagggtcaacaggatcaacaggaccaaccggtccaacaggagtaacaggatcaaccggagaaactggcgcaaccggatcaactggagaaacaggagtaacaggatcaaccggatcaaccggagaaacaggtccaacaggaccaactggtgcaacgggagtaaccggagccactggtgcaacaggaccaactggtgcaacgggagtaaccggtccaactggcgcaaccggagcaacaggcgcaaccggtccaactggagtaacgggagtaacaggggcaactggtgcaaccggatcaaccggatcaaccggagaaacaggatcaacgggagtaacagggtcaaccggagcaacaggagtgacaggtgcaaccggatcaaccggagaaactggtgcgacgggagcaattggtgcaactggtgcaaccggagcaacgggagtaactgggtcaaccggagcaacaggagtaacaggtgcaaccggatcaaccggagaaactggtgcgacgggagcaattggtgcaactggtgcaaccggagcaacgggagtaacaggatcaactggaccaaccggagtaacaggtgtaacaggtgcaaccggatcaactggtgcaacgggagtatccggagccactggagtaacaggattaactggaccaaccggagaaactggtgcgacgggagtaaccggagccactggagccactggagccactggagtaacaggattaactggtgcgacaggagaaactggaccaaccggagcaacaggagtaacaggatcaaccggagaaacaggtccaacaggagtaacaggatcaaccggagaaactggcgcaaccggatcaactggagaaacaggagtaacaggatcaaccggagaaacaggaccaactggtgcaacgggagtaaccggagccactggtgcaacaggagcaacaggagtaatcggtccaactggcgcaaccggagcaacaggcgcaaccggtccaactggagtaacgggagtaacaggggcaactggtgcaaccggatcaaccggagaaacaggatcaacgggagtaacagggtcaaccggagcaacaggagtgacaggtgcaaccggatcaaccggagaaactggtgcgacgggagcaattggtgcaactggtgcaaccggagcaacgggagtaactgggtcaaccggagcaacaggagtaacaggatcaactggaccaaccggagtaacaggtgcaaccggatcaactggagaaactggagaaactggagatacaggaccaaccggagaaactggtgcgacgggagtaaccggagccactggagccactggagtaacaggattaactggtgcgacaggagaaactggaccaaccggagcaacgggatcaaccggagtaacaggtgtaacaggatcaactggagtaacaggatcaacagggtcaacaggatcaacaggaccaaccggtccaacaggagtaacaggatcaaccggagaaactggcgcaaccggatcaactggagaaacaggagtaacaggatcaaccggatcaaccggagaaacaggtccaacaggaccaactggtgcaacgggagtaaccggagccactggtgcaacaggagcaacaggaccaaccggtccaacaggagtaacaggatcaaccggagaaactggcgcaaccggatcaactggagaaacaggagtaacaggatcaaccggatcaaccggagaaacaggtccaacaggaccaaccggtccaacaggagtaacaggatcaaccggagaaactggcgcaaccggatcaactggagaaacaggagtaacaggatcaactggcgcaaccggagcaacaggcgcaaccggtccaactggagtaacgggagtaacaggggcaactggtgcaaccggatcaaccggagaaacaggatcaacgggagtaacaggggcaaccggagcaacaggagtgactggatcaactggcgcaacaggagtaacaggtgcaaccggtccaactggagtaacgggagtaacaggggcaactggtgcaaccggatcaaccggagaaacaggatcaacgggagtaacaggggcaaccggagcaacaggagtgactggatcaactggctcaacaggagtaacaggtgcaaccggagcaacgggagtaactgggtcaaccggagcaacaggagtaacaggatcaactggaccaaccggagtaacaggtgtaacaggtgcaaccggatcaactggtgcaacgggagtatccggagccactggagtaacaggattaactggaccaaccggagaaactggtgcgacaggagaaactggtgcgacgggagtaactgggtcaaccggagaaactggagtaacaggatcaactggaccaaccggagcaacgggagtaaccggagtaacaggatcaacagggtcaacaggatcaacaggaccaaccggaccaaccggatcaacgggagcaacaggagtaacaggagtaacaggtgtaacaggtgcaaccggatcaactggagaaactggagtaactggtgcaactggagatacaggaccaaccggatcaacgggagcaaccggagaaacaggagtaacaggatcaaagggagtaactggtgcaaccggagaaacaggagctactggtgcaactggagatacaggaccaaccggtccaacaggagtaacaggatcaacaggtccaacaggaccaaccggaccaaccggagaaacaggagcaaccggtccaacaggagcaaccggatcaactggagtaaccggagcaactggagcaaccggaccaaccggatcaacgggagtaaccggtccaactggagcaaccggatcaacgggagtaaccggtccaactggagcaaccggatcaacgggagtaaccggtccaactggagcaaccggatcaacgggagtaaccggagaaacaggagtaacaggattaactggtgcaacaggatcaaccggagaaacaggagcaacaggagcaacaggagcaaccggatcaacgggagaaactggcgcaaccggagcaacaggatcaacgggagtaaccggagcaacaggagtaaccggattaactggtgcaacaggagcaacaggagcaacaggagtaactggtccaacaggatcaacaggagtaaccggagaaactggtgcaaccggatcaactggcgcaacaggagcaacaggtgcaaccggatcaactggcgcaacaggagcaacaggtgcaactggcgcaacaggagtaaccggtccaactggagaaacaggatcaaccggatcaaccggagcaactggtgcaactggagcaacgggagtaactggagccactggtgcaacaggatcaaccggagcaaccggtccaaccggatcaaccggagtaaccggagtaacaggtgcaacaggaccaacaggaccaacaggaccaaccggttcaaccggggcaaatccacagctgttttacagtgaaatagcaggccccgttccgcttgctattaacggtactgaaacgtcgattggtactttaagtgtgccaacagtcgcaggacaattaataaaattagaccttgccatttctgtagatgttacaacgacagctaactcaaactttacttttcaaaccagaatttatagaaacggagtattagtagatacacgctccgtccaaagaaatatcagcgctgcaattacgtcaagatttccaattgctacaacgtatgtagatgctaccacggtcacaggcacgacttcttatgagattaggataatcttcacaacagtaagtaatgtgagtggcagcaacgcactaaacctagatataaatgctattaggttcccttaataatagagaattaaaaaatcacttttttaaaaaaattcaagcatatgaaacaagaaacctacttttaaacagtaggtttctttgtcgtggtattgaaaccttatcatgtctcggaatatccctccaaaaattttttaaggtaataagaatactggtctgtatcaaactcgttgccgcatgcatgtaagacccaaggctctttctgatgagggatgcccactatatatcctttttttctgaactcaaaacattgagaagtatcatataaatgccatccgttaaaaatatcttttcgccatggaacatcgtactgagtcgccagtaataaaccgtctaatgcttgaactgctttcacagtttcatcaatttcatcaaataataaatagttgtacgtgctgcggtattcaatgacttttccggcttttttagaagcctcccaccaaatcccgctttgcggcacttcttcagctcctataacgcctatcatgccaagctgatcattctgctgaaagacatggagaatatcataaataaaggaacgattgatgataaatgtgtcctgatgtaaatacactttatattttgagtcagagtcctccattgccgcctggtagccggacgccatactgtctgcgtctcggatattgattaattctaccttcatatgcggcggtacagaaagagactgaagatgtcttagacagagatcataaagggtatcgtcattcacacatgtaataaagctaattgaattttcgtttgtatgctgattcatcttttctctgcctttatgacatattgataggctctggcctcctcctcaagatctgcatggtgaattcccatgcatgatctgacataagcaagtttgctgatcattttttcataataatgagtcgtaaaaacaataggctcgatttggatgatcttgtagcctgtttcatgaaacatctttttcatttcctccaaggtgaaaaaacggaagtgtgttttatcgagcagccctgcctgtatatacgtccatttgccggacagcagactttcgaaaatcgagatatgtccgatattcgggatgcttgccaagatactccctgtttcttttacataaggcttgatgttacctaaaactgcccacgggtctattaagtgctccagaacatcaccgaagataatgtgatcaaatgtgtttttttgaaaaggcagcttcagtgtttcaatgtctcccgttattacttcgtcaatataatgtgttgctttttcggcagctggtggataagactcgatcccataataggagcaattcgttttttccttcacagctgcgccaaacaagccttcagcacatccgacttcaagaatggttttcgcatgcggttctatcagatcaaatagctgccagttgatgcctttgtaatactctttatcttttagctcatactctttcatagaatcagcaagtgaatttttattgatttccatgatgttcacccccggagccggtctgcatctttagaatatcttcaaaatattttttgttggctagcattcttgaatcatggggacggtattgcaatgccgattcattatgctgataggcaagctgatgctggccgagtttatcgtagcagacggctaattgcaggtggggaagccaggtcgcgcaggcgcggttttgaaaagccaggttttctgctcctttgttttctattgctttttcataccaatagaccgcactctgaaaatcgtttttttctaaaaaagagtatcccagcctgcagcaggtttctgctctaggcggtccatagacgagcgtgtggagcacccagcttaattctttttccttcagccccagtgaatggtagcagtctgctaatttattgcacgctctgatattatcctctacccatccctgcttcgtttgtaaaaaacgtaaatagtactcaatcgcttgctccatttttccgtgatcacacaactcgttcgcatagtaaaataaatctcttggagaaaaatcctttcctgacgaggccattttttcataaattcggaggttgcgatctgcgtcatgactaagtggcaggtgagaaaccgctgcatcactgtggtgaagtttcccatatacttctaggtattcatgaaccgcgccgatccatttaaagctcttttcccgttttacgagccggtatctccttaagctggatgtgacgttattttcttcatcaaaagccaaatggtatttcattgagaccgcgtctatatccggatcaagcgttctttttaaatccaataacagctcttgatctttcttggtaaacacgtcgtcggcgtcaagccataagatatagtcggatgtcgcctgctgaaacgaaaaatttcgggctgccgcaaaatcgtcaatccatttaaaatcaaagattcggtctgtatagcgagcagcaatgtctttcgtcttgtcaactgacccggtatccacaatattgatctcatcagctatctcctgcacagaatctaagcatcggccaataacagcctcttcattttttacaatcatgcataaactgattgaaatcacatcgccacctccgttttattctgttttttctttatggcatggacaaacatgtaatcaatatgggcatgttttgacaagtgatccaaagacaaaccaaattgcccggcaaggaattgaagttcttgtaaaaagagctgtatgtttgattcagtatcggaggaatgggaggtgatggattttatgtcataaaggtattcaggaaatagggtatttacgttgcgaggtgtgatgaaatgtgtgtacgtcgatgcaccacataataaagagaaaaatgtatctgcataggcagtatttgggatgctgcaaatcagcgagccagaaggctttagataaacggcaagagtctcaattgtatgtctgggattttttgagcagtttaaaaggtcaccgatcaaaattacatcgaaaaaggactcagggtaagggaggtcgcatgtttccacatctgccgaaatgacttgttcgtaataggggcttgcaatggtctgtaataactcatccttttcaatcccatacaataaacaggattgccggttcaaaagttctgtccccgcagctcccgtgccgcaaccgatatgtaagatagagtcggcttccgctggcacaagtgctgtcagctggggctgggagtcaaagaatgttgttacatccaccttccatttatcgatgaagcgttgccggttttcttcgtataattgattgatgcttaaatctggattgcctgtaaacgtggcatgaccgtgatggtggacaaacgaatcaagagcgataattagctgataccccgcttgcagtacgcggaggcttaaatcatcatcctcaaatgaaccgcctacaaaacgttcatcaaaaccgccgacttcatccaacaccttctttttgacaagcaggcaaaatccgaccagcctcaatacagcttttgatctgcctcgctgctgcaaacagtaaagacgagaaaaatcttcaatttcttcaacgtttgtatagttaacgggaacttgctgcggaccgctgacataattgcttacaggcccgaccatgccgattttatcatcctgataaagcagcttgatcattggctccagccattgatttgttacaacagtatcattgtttaaaaaaagaatattgtcccctgaggcaacttcaagaccctgattacaggcttttgcgaagccttcgttcgtcttattaaaaatcgccttaattgaagttatctgtttgaggtagtcacgtgtaccgtcatgagagccgttatctataacaattacttctatacagtcattattcgtatgcttccatatgctctccaagcattgttttgttaaagctaattgattataagtcagaacaataatactcgttttcactataacctccgcccttcgccatatcattcggatactatatgtatatcgtaatgttcagacggaatgattctttcctgtaaaaaggagaatgctgcttaaacgtaaaaatgtgaatggttttttaaagaaaaagtcgatgaatttgttttacatttagttttcccttaaggggatcaacaaggttggggaattcagggaaatagggatgataagttgccttaaccagtttgtatgaaagttatatttaattctttctgtactaaatggtgaattaggagttatatatttaaaggagaataccgatgagggcattattttatttaatacgtttatagcaggggagaaggacgaaatatcggtcagataaatttttatataggtttcgtgactttaaagggatcaattatgatttatagaatgttttttgtaactcaaactagttgagtactactttagaaagaatcatcgtgtacatataaacaatgataatttaatgaaatggacatcaatggtgtttccagaacatttaacgtagtttaaataagatttgattgacgtatcagaaattgaaaaaccgtccttagattagcaacatattgaagagatggatcttctagtctatgaggcacttgaatttaacaaagaattgctatcgagactatttgagatgtgtcgtaaatccactaataaaatctgtttttgaagaaatgtttaattcttaaaatggttaatcaatttaagtgcttcatttaagtctcttataagccgataaagtttactggaggacacaaatcataaaaatccccccaaaaaaatttttaagggggaataatacatatttaagaagtgtgacctctacttgcaacttcaaatgagtctttctcaataaaatatccaatatttttactccgactttagaagaagagatcatttgctccaacacaagccctcctatattaaatatgtaatattttatcatatttaaatgaataaggaagattaatgttatcttaaaaaacaaaaaagcctcctgcaaattatgagaagggtaagggaatatttttgagaatcatattccattgcttgttcacagtcagtaatccttgagttgttctagcaagaggcaatattgttgaataagaatagttttaaagaggttattgttgtcttcatattgaaataaagactaagtatattagaggggagttactttaatgcatatcacaacaaaaaggttattgatacgtgaatttgcattcacagattggcaggctgtatatgagtatacatctgatagtaatgtaatgaagtatatacctgaaggggtttttactgaagaagatgcaaaggcatttgtaaataaaaacaaaggtgataacgctgaaaaattccctgtcatactaagagatgaagactgtcttataggccatattgttttttataagtattttggtgaacatacatatgaaattgggtgggtgtttaatcccaattatcaaaataaagggtatgcttctgaggcagcccaagctatcttggaatatggatttaaagaaatgaacttacataggattatagctacgtgtcaacctgagaatattccctcataccgagttatggagaagattggaatgagaagagaaggcttttttaaaaaatgtattccaaaaggcaatgaatggtgggatgaatattattacgctattttagaggaagagtggaattgtaagagaggtaatgcaggaaattgaaaccataacagctatagaacgtatagtgatagtagggcttatagtgcttaatatgaatgatgtgagaggggtatccaaatgcaaattcatctcaccaaaagcggaaaacaagacaatcatcataaatggttaggaactgtcttgctcagttggggaacattcgtatttgctttgttttttgctactttagtcggttcaatggctagccaagcaggagcttccaagcttttgaagcaaggcatccaagcaggtttagtcacattaataactgtcccgttgctctacattcttcttaaacggatgtctagtagacccttttattctataggactgtctgggtggcggcaagccattccgaaagccataataggagcaatatatgtgattgtactatccgggtctggtttcgctatcgcccatttattaggctggatcaaagttacacaatttcacttctctgtccatttagtgacagcattgctcttaaatatgattatcgctttcttttatgaagcttttccagaggaattaacttttcgggggacggtgtactatgctctaaataagcgttggaactgttttatggccttactcctacagccgatcctgtttgtgcttgcaccaataactgtaagtggcttgcaatatatagttggaattgaatcatctgctatcacattagattacattgttttattgttgggttttggattcatccttcaactcctgcgtattgtaacaggaagcttatggacgtctatcgcttttcatctagcctttcttgaaaattctcggttcttcgtcctgcaggggaaggagcgctttattacctatgaagaaattgttccgggaacaggtgcgctgtttgtgatcttttttatgttgcttattgccggtactctactcttaatacctgttgcgataactcgccgaaatactattcaatggcggaagaatgagaaatgcgaccaagatgtttaatttctaagtagaacagtagttttaaagtgattttaaggaggatctagacaatgttgaagaagcattcatgatgaaagattagtagattttgattctcaaggtggaaaccatattagtgtttatttagttactcactttgagttatctgatcaatcgtattcttttgggtatgaagcataactgttcgtatgcaatggatattctaagcgttaaagaggaatttgatttcgatttcccatttaatatgcttgcaataaaaagctatgtacaagaattaataaaatgttagggattgatataactctgcctgaaatgaaagaaagagattttgacaaactttctcaagattaaataaaactacgattttaaagagaacggagacttgctttcaatatgaatgttaaaaaaactgcagctgttttttcaatcacgattccaattatctcagctatcctaattattaatttttttacgggagttatgtcaattccatggcaaggaatgccggtgttttttccattattgctttctcctataggaatcattttagcgttcgtttcaataaagacaaataaacggtgtgctttatatgggattgtcttaaatgcaattatgtttccatttccttttttctggtttatcggaggggctttgttttttggagtttaaaatccattaggcattacgcttatacattggtattttcgaacttgtcaaaagaaggaataaaaaaatttcagaattgcttggctttactttatgttgaaaggggtcgagtaaggtggataggaaaaaggatgaaatacaaagaaaatatagggaacaaatgagggagaagaaagaacgagaaaaagaagatggcagttcacatacttttgaaattgttgttgtgctagccattatcattttgatgtttttctttaattcagttttcaaggctttttagatattgtacagatgactttcaggatgtttgaaaaaataaccctttgatatatataccacatgaaagtattgaaggacttatgaaaattcaagagccagttgaatcttaataattaatcaccaaataatggggatgtaaaatgaaattgtataatgaatttatcaatatagctaaaatttttaataaagagctagacatcattccattattatatggatctttaggtcttgaaaaggtaactgggttagacttttctccagaagatattgatctccttattcctttaatttttttagaggaaaagtgggaaaaactaaaaaaagtgatggaactgcatggatacaaaatggttgatttacatgagcatgaatttaagaaaactaatacaaaaataggcattgcttacattgaggatttaaaagcatttgcagatgtagactataataatctagaggtttttgaagatggcggagcgaaatatcatttgctaacgattgatgattacctcaaggtttataaaaagtctttattagatggttatagaagaaggaagaagaatcataaagaccaaagtaaaattaacatattgaataaattaatacggaattaatttctgtattctcttttgtttccagtctcaattaaaatttttaagattaaaataagtttgaaaggataaatcatagtgtttaacacagccattaatcctcagacagtcaaaaagccatttctactccggttgaaagcttttcaatttttgcttcttatttatctttcctgtattgatatatgtatgtagggttggacttataacataaactattctggccattcctgttctttcaattcatgaccgggcttgccatcagcataaatctaggctaacagtctccatacatcctgtgatcacctttatcaaactcttaaatgcaacttaccactaaccaattctttatttcgcatagatcatctttgtcatgtgtttacacaagaatctgttttggactaatcgtcgttaactgatacatgacattcgcaaatatttgagacactgaatataacgaaacagtcaaaaatcaatatttaattcattctgtttaaactttctgaaaaagatgttgaaaaagttgaaaggattttataatattaaaacaagttagtttgttcgatcaacaaactaataagatgaactttcattgtccacaagataaggtcttactaaatatggatggaagggggataagagggtcgatttaatggagctaaacaatataagaaacgaaagaatgaggcttttatccttttccaggtatataaggtatgacgagaaaagatgaattttttgcttgctgatcaccatattttttcgcactgttttgaaagcgcttttataaaagtttactgaccgtaaattcgagaaattgttataccgtttcacactgttccatattaaaggatcgaaaaggggagaaatcatgctcagtgaaaatgtaaagaagattagcatggttgaaaaagttggatatgcgtctggagattttgcttgtaatttaatttatgcaacagtgtctacgtatcttttgttcttctatacagatgtttttggtttatcggcagcagcagccggtactatgtttttagtggttagaataatcgacgctctcgctgatccttttatcggaacaatagttgacagaacgaacagcagatttggacgctttagaccgtatcttttattcggagcttttccatttgtcatactggcaatactctgttttacaacaccagacttttcggatatggggaaattaatatatgcctatataacctatgttggcttgtcgcttacatacacaacgataaacgttccatatggcgcgttaacttctgcaatgactagaaataatcaagaagtggttagtataacttctgttcgcatgttatttgcgaatcttgggggacttgtcgttgcattttttgttcccttactggctgcttatttaagcgatacttccggcaacgagtctcttggctggcaactaaccatgggtattttgggaatgataggcgggtgccttttaatcttttgttttaaaagcacaaaagagcgggtcactcttcaaaaatccgaagagaaaattaaatttacggatatatttgagcagtttcgtgttaatcgtccacttgttgtattaagtattttctttattattatttttggagtgaattccatcagtaattcggttggcatttattacgtaacgtataacttagaaagagaggatttggtgaagtggtacggtttgataggaagtttgcccgctttggtcattttaccgtttattccaaggcttcatcaatttttggggaaaaagaaattactaaactatgcattattactgaatattatcggcctcttagctttactgtttgttccgccaagtaatgtttacctcatacttttctgtcgattaatcgctgctgctggaagtctcactgccgggggatatatgtgggcgcttattcctgaaacaatagaatatggagagtacaggactgggaaaagaatgggtgggctcatttacgctataatcggatttttctttaagtttggtatggccttaggaggagttgttccgggtctggttcttgataagtttggatatgtggcaaatcaggcacaaaccccaacggcattaatggggattctaattacaacaaccattattcccgtgttcttgctggttctagctttaattgatattaatttctataacttagatgagaaaaaatataaaaacatggttcgagaattagagaatagagacaaagtttatttggatcatattgatgatttcaaagcttaaaaaagaaaataaactgaggaggagtcccaaatgaagattaccaatccagtacttaaaggattcaatcccgatccaagtatttgtagggcaggaggggattattatatcgctgtatctacatttgagtggtttccgggagtccagatacaccactcaaaagatttagtaaattggcacttagttgcacatccattacagagagtttcacaattagacatgaaaggaaatccaaattcaggtggggtttgggcaccatgtttaagctatagtgatgggaagttttggctgatctatacggatgttaaggtagtagatggcgcatggaaagattgtcacaattatttagttacttgtgaaacgattaatggtgattggagtgagccgattacattaaatagctcgggatttgatgcttctttgttccatgataaggatggaacaaagtatttattaaatatgttatgggatcaccgtattgatcggcactcatttggaggaattgttatacaggaatattctgataaagagcaaaaattaatcggtaaaccaaaagttatatttgaaggaacggatagaaaactgacagaagctccgcacctttatcatatcgggaactattattatttattaactgcagaaggaggaacacggtacgaacatgctgctacaattgcccgttctgcaaatattgaggggccatatgaagttcatcccgataatccaatcttaacgtcatggcatgacccaggaaatccattgcaaaaatgtggtcatgcatccattgttcaaacacatacagatgagtggtatttagctcatttaacgggacgtcctattcatcctgacgatgattcaatttttcagcagagaggatactgtcctttgggcagagaaacagctattcaaaaactttactggaaagatgaatggccctatgtagtaggtggaaaagaaggaagcttggaggtagatgcaccttctatacccgaaacaatatttgaagcaacgtacccggaagttgatgaatttgaggattcaacattaaatataaattttcaaactttaaggattccattcacgaatgaattaggttcattgactcaagcgccaaatcatttacgattattcggtcatgaatcattgacctcgacatttactcaggcatttgtagccagacgctggcaaagtctccattttgaagccgaaactgctgttaagttttatccggaaaattttcaacaagccgctggattggtgaattactacaatacagagaactggacggctcttcaagtcacgcatgatgaagaacttggccgcattcttgaattaacaatatgtgacaacttttctttttcacagccattaaataataaaattgttattcctcgtgaagtaaagtatgtatatttaagagtaaatattgaaaaagacaaatattattatttctattcttttaacaaagaagattggcacaaaattgacatagcactggaatcgaaaaaattatcagatgattacatccgtgggggaggattcttcacaggggcctttgtagggatgcaatgccaagataccagtggtaatcatattccggccgactttagatattttcgttataaagaaaaataatttgcacatgaaaaaggagatttctattttagaactcctttttcatatgagaaggtgcctatgtcactattgcttcagaaatacccctagaataaaaaaactcatctttaaagatgagctgtacattccataaaaattacattgtaaccatgtccagaaaatgatcaatcacaatggaggacattcctaatgccggcgcattctgtcctaaggaagatggcaataattcatagctattgcctaattgggaataaacccttgacgatacttcacttctcattgaatttaaaaccataggatgtgattcaattatgctatttcttaaaattacggcctgtgggttgaaagtattcaaaatattggtaaggcctattcctaaatagaatccaaaattctgtaatgcgtttaaggttccgatatcattcagatgggcgaggtttatgatgtcttgataggacagttttttctctttggtctgaagagattttaataaagccttctctgaagcatacaattcccagcagcctcggtttccgcaactgcatttaggaccattaaagtctattgtcatatgtcccatttctccagaaaagccgcttactcctctatataaatgattgttgataataacaccgatccctatccctgtgctgatacttacgtaaataatgttatcgtgattttttgcagctccaaatactttctctccatatgcgccagcatttgcctcattttcaataaaaacaggcacattgtacttctcttgtatcgaagattttaagtcaatatctctccagttggagttcggagtgaaaacaattttttgatctttatcaatgagtccaggcacgcaaatacctataccaataagcccgtacggagattggggcatatgcgtcataaagtgatgaatcatatcaatcaaaatgtctttcgttatttctggagaattggattccaaatgacggtattgatcaagaacgatcgttccttcaaggtctgttaaaatgccattgatataatccacaccaacatctattcctacggagtatcctgcctttttattaaaaacaagcatgacaggtcttcttccgccacttgattgtccttgacctatttcaaataccagattttctttcattaacgtgtttacctgtgatgaaacagttgatttatttaatccagtcatttcagataattttgctcttgaaataggtgaatttttaaggatttcttttaataataacttttgatttacttttttgacaaaggtttgatcagcgatatccacttcatccactccatttgtttaatctttaaattaagtataaacatagtacatagcgaatcttccctttattatatctaatgtgttcataaaaaactaaaaaaaatattgaaaatactgatgaggttatataagatgaaagtaagttagtttgtttaaacaacaaactaataggtaacttacaatatgaaataaaatgcatttgtatttgaatgatcaggttttgaatttatttttaagggggaaatcacatggctcaatctcattccagttcaaccaactattttggaagcgcaaacaaagtggtttacgaagggaaagattcgactaatcctttagcatttaaatattataatcctcaagaagtaatcggcggaaaaacgatgaaagagcatttgcgattttctattgcctattggcatacatttactgctgatggtacagacgtttttggagcagctacgatgcaaagaccatgggatcactataaaggcatggatctagcgaagatgagagtagaagcagcatttgagatgtttgaaaaactagatgcaccattctttgcttttcatgaccgggatattgcaccagaaggcagtacgctaaaagagacaaaccaaaatttagatatgatcgtgggcatgattaaagattacatgagaaatagcggcgttaagctattatggaataccgcaaacatgtttacgaatccccgtttcgtccatggtgccgcgacttcttgcaatgcagatgtgtttgcgtatgctgcagcacaagtgaaaaaagggttagaaacagcaaaagagcttggcgctgagaactatgtattttggggcggccgtgaaggatatgaaacattgttaaataccgatttaaaatttgagcttgataatttggctagatttatgcatatggcagtggattatgcgaaggaaatcgggtacacagggcagtttttgattgagccaaaaccaaaagagccgaccacccatcaatacgatacagatgcagcaacaaccattgcctttttgaagcaatatggcttagacaatcattttaaattaaatcttgaagccaatcatgccacattagccgggcatacattcgaacatgaattgcgcatgacaagagtacatggtctgcttggctctgttgacgcaaaccagggtcatcctcttttaggctgggatacggatgaatttccgacggatttatattctacgacattagcaatgtacgaaatcctgcaaaatggcggcttaggaagcggcggattaaactttgacgcgaaggtcagaagatcttcttttgagcctgatgatctaatatatgcccatattgcagggatggatgcatttgcaagaggattgaaagttgcccacaaattaatcgaagatcgtgtgtttgaagatgtgattcaacatcgttaccgcagctttactgaagggattggtcttgaaattatagaaggaagagctaatttccacacacttgagcaatatgcgctaaatcataaatcaattaaaaacgaatctggaagacaggagaaattaaaagcgatattgaaccaatacattttagaagtataacaggataagctccagatcctgctatcaataccaagtcactgaattacccgtcatgattcctttcctattgcttgttgttatgacgggtaacttctataattaggatttatttagagtgaatggtttttaaaagggcaaggagtgaaaaaatgaagtatgtcattggaatagatcttggaacgagtgctgttaaaaccattttagttaatcaaaacggcaaggtttgtgcagaaacgtccaaaaggtacccgctcatccaagagagggcgggatatagtgagcaaaatcctgaagactgggtacagcaaacaattgaagcattggctgaattggtttctatatccaatgttcaagccaaggatattgacgggataagctattcgggacaaatgcatggattagtactgcttgaccaagatcttcaggtgttacgtaatgcaattctttggaatgataccagaacaacgcctcaatgtataaggatgaccgagaaatttggcgatcatcttcttgacatcacaaaaaaccgtgttttagaagggtttacattacctaaaatgttatgggtaaaggaacatgaacctgaactttttaaaaaaactgctgtgtttttgcttccgaaagactacgtgcgattccgtatgaccggtgccattcacaccgaatactccgatgcagcaggaactttacttttacatattactcgcaagaagtggagcaatgatatttgcaatcaaattggtatttctgcagatatttgtcctccgcttgttgaatctcatgattgtgtagggtcgctgcttccgcacgttgccgccaagaccgggctattagaaaaaacaaaagtgtacgctgggggagcagataatgcttgcggcgctattggagcaggtatcctttcttccggaaaaacattatgcagtattgggacgtcaggggtcatactttcctacgaagaagaaaaagaaagagactttaaagggaaagtccacttttttaatcatggaaaaaaggattctttttatacgatgggcgtcacgctcgctgcaggatacagcttggactggtttaaaagaacgtttgcaccaaacgaatcgtttgagcaattattgcagggggtggaagctattccgataggagccaatggactgctatacactccttatttggttggtgaaagaacgccgcatgctgattcttctattcggggaagcttgatcggaatggatggagcccataatagaaagcattttttgagggcaataatggaaggtatcacattctctttacatgaatcaattgagctattccgcaaagcgggaaaatcagttcatactgttgtttctattggtgggggagctaaaaatgatacgtggctgcaaatgcaagctgatattttcaatacgagggtaattaagttagaaaatgaacaagggccagctatgggggctgcaatgctggctgcctttggaagcggatggtttgaatcccttgaagaatgtgcagagcagttcattcgtgaggctgctgcattttatccaaaggcacaaaatgttcaaaaatataaaacactatttgatttgtataagaacatttatactcacacaaaggatctcaatcaagctttgaagagctttcgaaaaaactaatgatgttattgtctggagatcaacgaaagaacaattaacgattaatcatcaaaggcctttgatgacatggctgccttcttttgaaaagatggtgagaataaggtatcgcaacctttaaacagtattggagtgtccagcagacaaaacgaacgagcggaaccgtattctgtcagcgaacacttcaagaagtgagaaagcttaggaatgccaatgggtaagatgtatgaaaccgcgctaacgacggtagagggatctcttgatttatgatgaaataggaaggatgtttacacacaaataaccccctcacattgacgtgaaggggtgttttttattgttactatacagcggaaattttacaggctagttgcatgattttagcttgataagcagaatggaactagactctccatcatctctttctaattctttggaaactgcattctgctaggtttgctgctttttttaacaaacagtgtttttctatttcacacagccattaaatcctctgttcgtcacataaccgctcttactccaaattgacagtttatctgattttgcttcttgctcatctagtctgaattggtctatgtattttgtgttaggctcatatacatatgctactctggccaatccctctttcaataatgtctcttgaacagatttgccgtcaacataaacgtatgctaacagtcttccatacttatctctgcgatcgcctttatcaaattccagctgtagcttaccgctgttgaccaattctttatttcgtttcgacgcatcctcaccgtatggttgaacacaagaatttggtttcttcgtctcaggtgtatcaacgagcaagtagcgcactgtgtcttcctttccgttgtaaataaccttaatcgtatctccatctattgctctatctaatgtaacatcgaccaatttcttctgattttttgaatgaggcgtgccggccttttgttctgtctgattatatttattagattgagtatcttgagagacttgctccgtcccattagaatctgaatggtttttggctgcgtgatttgatccgcaagctgccaaagtaatacttaaaacgattgcgatcatactgatcaaaatcttcttcatattgattccctctttatcattttctctttttgcgtttaaacatcatcattataacgatatggacattttttgtgaatggaaaacttcaagggaacttataacactccaaattgccaatagttaactttacaacgagatgatcaaaacatcaccatcacatagcggaaataaataatcctgaaaataatattgactgaaaatgcttttggaattatgataatatgagaaatgacaataatgtaacaaaaacattactacaacataacaactgatagcttaggtttattctattggctaaaaatgtaaacggttacaaatccagaggcgaaaatctaagatagagatgactttagttttgactcaatatccacactgaaagagcttattaagtattcttaataaaggcaggggaaatggatatgaatgaacatcgaaatcgaaggttgaaattaataatgatttcagcaacttttggagggcttctctttggatatgacaccggagttataaatggagctttaccttttatggcaaggccagatcagcttgatttaacaccggttacagaagggcttgttacgagtattcttttattaggtgccgcatttggagcgttgttatgcggaagattggctgatcgatatggccgacgtaaaatgatccttaatctttcctttttatttttcctggcatcactgggaacagcgttagcacctaatgttttcatcatggcggcctttcgttttttactggggctggctgttggaggagcctcggcgatggtgccggcctttttagcagaaatggcaccgcatgaaaagagagggcgtatggtaacccaaaatgaactaatgattgttggcgggcaatttttagcatatgtttttaatgcgatcctcggtgtaacaatggcaaatacgggacatgtttggagatacatgctagtcatttgtgctgttccggctatcatgttatttgccagtatgcttaaggtcccagaaagcccccgatggctaatcaccaaaggcaaaaacagtgaggcgctgcgagttcttaaacaaattcgagaagataaacgtgcagaagctgaatgtagaaaaattcaagaagcggtagaaaaagatacagcactagaaaaggcatcactcaaggacttttctacaccatggctgcgccgtcttttatggattggaattggtgttgccatcgtgaatcaaattacaggtgtgaactcgattatgtattatggcacacaaatccttaaagaatctggttttggtacaaaagcggctttaatcgctaatattggaaatgggctgatatcagttattgcagttatatttgggatttggctggtcggaaaagtgagacggcgtccaatattattgattggtttggcggggacgactacagctctcctattgattgcgattttctcaattgtgcttgatggatctatggcacttccttatgtagtgctttctttgaccgttttatttcttgcctttatgcaagggtgtgtaggacctgtgacttggcttgtcatagcggaaatattccctcaaaggttaagaggacttggttctgggataagtgtttttttcctttggatattaaactttgtgatcggttttgctttcccgatcttgcttagctctgtaggtttgtcttttacattctttatatttgtggctttaggtgtattggcaatcggttttgtgtacaaattcatgccggaaacaaaagggcgtacacttgaagaattagaagagcattttcgttctcgacacgatcataatactcctgaacaatcagttattgagttataaatatgttgaaaatctctcttcttataggagggatttttttagtttcagaaaaaacaaaatccctctggtagagggattttgattcagcattttaagatgttctacacgtataatactggagttgatactttaaaaatctcgccatctcttatataaaaacgagggatgcggcggcttaatgtagacacgacttcatagttaatcgtattgagcatttcagccacttcatcaacggaaatctcggctcctttttgcttaccgtaaatcacgacttcttctccttgtttaccttcaccgttttctcctaaactgaccatgatcatatccattgttactcttcccgccactggcactcgttttccgcgatgaagaacaaatccgcgattggaaagggcacgagaatagccgtcagcatagccaatcgggagtgtagcaattacttcattaggttctgcgatgtatgtagcaccatagctaacggttcggggttctgtccgcatggttttcacataagcgatgcgtgcctttaaacttaacgcaggttcaagcttaacgagatttagttgtttaatataggctgaaggatataaaccatataagccgatacctaaacggatcatatcagcgctaaattccggaaatgcgatagctgcagccgtgttgcacatatgcacggtgggcagctcaatcccctgtttttttaaaaagctgagaaaactgatgaatttttcatgctgcagctttgtgagtgtggtgtccggttcatcagctgtcgaaaaatgtgtgaaaatccctgtccatctgaggaatttacttgcctttaaggctttcactacttctaaaagttcttcctttgtgcgtacacctaatcgtcccatgccggtatccacgttaatatgaatggccagccggttagcactcgcttctttttccaatatctcgtttgcttctttcatccaatcaacctgaaatgctgataatgttatattccaagctgctgacttctttacacaactaagggatgtaaaaccaagcacaaggataggtgctgtaatcccagctttacgtaaaacgattccttcctccacactggcaacagcgagctcactcgccccgtgttccagtgcatggcgtgccacttctatagacccgtggccataaccgttcgcttttacaacagccataattttgctcttatgtggaatatgacggcggatcgctcgcaaattctttttaacggcatcaagattgacttcgatccaaacttctcggcaaagctttatcatcaacgcttccttccttcttatggattgtaaataccacctattgccgcaagaataaatgttaattgttggatgattcgatcttattttattcaactttatttgaaatcattcaacagcaaatccatgtgatacgagaaggtgcctatcaatgttcgaataatagcaagtacgggatacatgaggcttgtaagtggggtgttaatggatgcggcgaccgaggattacaaaaatgattatttgttttgggacatttttttctaagggtagatgataacgagaaatctaatcaggaaatacttaccgttgttatgaacattgaagaaccttttaaatgagaagggctgaggaaattctgtaaaagataatcggttgaaaaggcagtcgattccttgttccataaacctaacatcagagtatataattatactcgtattcacaaaaatcgtttaagtaaggggtatacatgaataggggagttagttttcaaataccgaatgaatatggaaattttctatggagaatactgcagccggtagaaatagctaattataggtggcaaacgagtggggaatcttattttgttgtagaaggagagctcgatgatgaggagctttttcatgactacgcaattgttgagggggcagtttttgagcaacaattaaaaacgaatcagtactataccattttcgttgaactgaaagcatttccatatggaaaaatggttaatcaagtcaatacatatgaagagtttgctgacagtgattgcgaacttgtccttttgatagcagataatagctacgtttcgatttactgtaaaaacaaaaatatcattgaaaaactttacttcaatgctttacagaatgattttgaagacgttcaatttataactgatgaaaatgacacaagaacaagccttactgtatgatactcaataaaaattaaaggagctagtacatgacaatgcaaattaaaatcaagtatctagatgaaacacaaacaagaatcagcaaaattgagcagggagactggattgatcttcgggcagctgaagatgtaacaatcaaaaaagatgaatttaagcttgtcccattaggtgttgcaatggagctgcctgaaggttacgaagcacatgtcgtccctcgttcaagtacatataagaactttggcgttattcaaacaaattcaatgggtgttatcgatgagtcatataagggagacaacgatttctggttctttcctgcttatgcattgcgtgatactgaaattaagaagggtgatcgtatctgccagtttagaatcatgaagaaaatgccggcggttgaattggttgaagtcgagcatttgggaaacgaggatagaggaggactcggttcaacaggtacgaagtaaacaaaataaatccttggctgtcttcatgctgtgtgattgatcaatggaggtttcagccaaggtacaaagaaatacttttatctaaatttttataagtaggggaaggcaactacaaactagtaatgccactaataataagccaagttaaatgacatgtgttcattaataattgaatttacagcagccatgagcacaaaaaaatctgagtatcgtcgataaatatcataaaaaaccccccggtatgtcgccggggaataaatagacgtttaagagatttagtgatgttttttatatgattcgacaaaatcataataatgatcatcgtcatcataatactttttttcgtaatgataatcgtgatcatcgtaatactttttatcatggtcatcatactttttgtcgtaatcataatgttttttatcatgatcataatacttgtcgcaatcataatgcttcttatcattgtcgtaatactttttgtaatatgtttttttccaagtgtaatactcttctttatattttttataataacccaattaaattcctcctttatgttattcgaatttaatttatgaagtttaaatgatatggtatggtcaaatgaaataagaatagtaaaaagaggctgtttaaaacactttctgaaaaacaaaacggatagctgtttattaaaacaagagcgagagaaagcactcaatcactgtaaaataatagtaaagtgtatagagaggattaatatacgtaaaaagggactttctcattgaagaatatttgaacgttatggttaagattcagagctctatgatgtgatttttaacactgcttttgaaggatttaaagttagacatcaaaaacaaacagcaaaaccggttagaaacagatcatataaggaatgaaccgctgccaaatatcataaaaaagttgttaatgatcaaatgaatgaaattagagagaatttattttaaagaaagcccaattgcacatggacaaatgacaattgatattgaggtaaaatacaatgcattaaatcagaaaaagctattggaggatttaatgtgtttagacaatttccaatttggtatacacaaacacctgactatttgaatttttatgtaccgcaatatcaaaccatttcgtataatcctcaacaatgttatcaacggtgtatgtaccaaactggcggtaactatgagctatgtgacagactatgttatggagaaatacaggtgtaaaagaggggggattaactcctctttaaacacacagtgagtggaataagatcctcactttatctgcaagtgcttagtatttgcgataatattgcattcgtaataaattatgcttagcaactgaaaatgaaagaaggatatgaatagtcatgacgcaattcgataaacaatacaattcaattataaaggatattatcaataatggaatctcagacgaagagtttgatgtaagaaccaagtgggactcagatggaacaccggcacatactctaagtgtaatcagtaagcaaatgagattcgacaactcagaggttccgattttaacgacaaaaaagcttgcctggaaaacagccattaaagagttgctctggatttggcagctgaaatctaatgatattaatgatttaaacaagatgagcgtacatatttgggatcaatggaaacaagaagacggcaccatcggacatgcatatggatttcagttggggaagaaaaacagaagtctaaatggagaaaaagtggatcaggtagactatcttcttcatcaattgaagaacaatccatcttcacgcagacacattacaatgctgtggaatcctgatgaattagacgcaatggccttaacgccatgtgtatacgagacacaatggtacgttaaacatgggaaactccaccttgaggtaagagcacggagcaatgatatggcattgggaaatccattcaatgtattccagtataatgtgttgcagcgcatgattgctcaagtgactggttatgagcttggtgaatatatctttaacattggggattgccatgtgtacacacgtcatatagacaatttgaaaatccaaatggaaagagaacagtttgaagcacctgaactatggatcaatcctgaagtgaaagatttttatgactttaccatcgatgatttcaagttaatcaactataaacatggggacaagcttttatttgaggtagcggtttaatgctgcctttttattgttatttttcagaatataagctggcattaggctaaaaatgaagaaatttcttcttcatatttctataaacaaatagtaaacaaaattggagcccaacgcgaaacaaaaggattgttagaagcgttgggttctcttagtacaagtgaacaacgattgcgtggtctgaaaaattaaacgaacgatatgaaaaggccattggttttataaggtgttaattcctcctattaatatcataaggctcaagaaaattgtaatgaaaagaaaagcccatactatagctgtaaaaggattgttgagtcccatcctttctttccaatttatattagtggatcgattggttttgtattttattaactggatacataagatcacattaaaaaaaactgaaataacaagagctataactaaataaaggttcattttcatcaacctttctaggttttttaaacacttgaatagcttaattgtaaacctaatattaacatatacatatttcaccttaaaagaccagcatcgtgcaatgaatacaattactttgtgcagttctaggttatttgtttttattatgaaactttttggtccctggctaaaattcaacttaaaaatgaaaagattgaaattatccatgattgtgtttctgcgatggattgccttaaaatttggtagggatgaacaagcactatattaaataatactataccaatgaatttctattagaaaaattcataatattttaaaataaccatttaaatatatttctagaaattgtatacttatatggtactaaatgaatacatagaaaggactgttgtcgatgaaaaaagttttttgtaagttagccattagttctatagctctatttaccctatctcttcctaatggcaatgtattagctgctgaaaaaggggaagaaaaacctgtctcaattaaaggcgttgagtcacaagtgcatactgtatttgcaaacgagacaactggggtaaaaagcaacttaggaggaggagagtttactgcgcaatttgtgaatgattttcgtaatgttaagatgaatgtaaaaacatataaaagctggtctagctttaaaagagtttctgataatatagcaacggggagtaaaggaggatctattactgcaaacaaaacagttacttttacaacaactgtcagcggatctataagtggtttaggaatatccactgcaggctctgtagctagctctaaaggatacactctaaatgttggagcgaataaaagagtctatatggcatatagagttaggtataatgtagaagaagggtacaattgtcgtaaggatatagttactggtaaatgtgtatcaaagaaaaaatacgtagttaaaaaacctatgtatggagaatatgcactgaaaaactattaattttatataaaaaagattagctataaaagctaatcttttttattaagaagaaaatatcctaattttgaaacgagatacaaagtgaaagcaatcattaatgttctcgatataacaattccatgaatagccaaatcatatccagcaggtatcaaagcttttgtattaaacataaaatacattgataccagaagagcaataataactaaaataattccaaaaagacctatttttccgtatttcatacaaattccaccctatattaaaatatgataaataaccaaaggagctgaagatttcgataattcactttacaatcatcaagcaatgaccaacatcgaacctttgttggtgtaattgtcaacttaagcttcaagttagttatttttgtaattaaaaaataattgaaagccccataaataaggggcttttaatttatgtagttctatagtaattgaattaatcataccaaagttatttcaaaatttcaacttttgcttatgatgtttttatcatcgaaacaaaaatgtcttaattctaacgctgttcaaataaagtttcatataaaaaggaagtactactgttcgtaaatctatatagggagtggattccgacacggttttttatggagatggaaaattaattataaaaccgccagacaatgctggcggctttttgctgcttcgtttatttattaacagagatcgtaacgttatttcctgcaactgaaacctttgcgaaatcctgtgtatctaccacaggagtgacggctttattgtcgattgtgatgttgttaaaagatgtcgaaaaggttgctttgatcgcatcacgctggctttcatacgaaacagccgcggtagcaagggttttccattttgaaatcgtgccgatgttggttccttgaatttctgtgataatccgtccggtgtagccgtcattgttcgttccccaaagggtcatgcgcgtattgccgcttaaatttttatagattgtcatttggactgtgcttccagggcggaagcctttattgtatgtgaatttgtcttttccttcgatgtacgtttcttcatttttggacccaaccttcatgaggggcttccagacgttgtattgtttgctgtactgaagcccgatatcggcttcagttccgcttgttgccctaaagccagaataaatatagggagtagagaccgagtcgttgtttttgacagtttcaggaagcgtgattttagctgtaaaaatggcgcccgtactgttcaggtagacacggccgccgattccgttaggcagctgggatgctgcttttgcgacttgagcgtctgccgcgggtaaacctggtatacctgatgaaagggttccgaaaagaactgcagttcctactgcacctgcaatcaatacttttttcatcaaaattccccctttagatagtggtttcgccatttattatacctaattttggaactggattgatgtatataaatcgacaaaatatttcattttgagtgaagtaagggacgaaacgcttcgccaatctgaaagctatatacctttatcagaggaaagaatgagatcacaatcgttttaaccgatttgaaattttcctcaaaataaaagtacaaatgcttaaagaaacgattattaaaagaatgcccgctatcgtttcccagcctgtaaaaaagaggtgacgtttcatcaatgtctgtccttgtaaaatgataaaagcacagataccgactaagaaaagaaaacaaatacttaggattgctaacgctttacgtgagtatgttttcatttcatctttaaaatacagcaatacgaaaacaaagcagataacattggctattgtgcttatcacctcaaagcttttcatgacaactgatataaatagacaaagtaaaatgagataaaatacgatgtttctatacaaaaaacctctccttttatgtatgatcctcaaagagtttataaaagtttctttgtaactgcaataaactgaatgcgctcaattatgaactaactaaactatgtactaaatattcactattcattttcagattcagtcaccaaggttttcatagaaagggaagcttcagaaatatacatatagtgcacaaacaaaaaagacccggcaatagccgggggaaagtaaaaacgaggagatgttaatggcgtttagtagtgttttttatgctttttatactctacaacataatcatagtcttttttatcgtgatcataatattttttatcatagtcatcatattttttgtcgtaatcacagtcataatcttttttatcatgatggtcataatcttttttatcatattcgtaatacttcttataatacgtttttttgaccgtataatactcttctttgtattttttgtaataacccatatatactcctcctttatttttactacgctttattatacggcgagtagattttgcggcttggacagttaaaatcatagaaggaaaaaagggctgtccaaatgatagaaaaagacagatgacacaaaaacaaatcaaaataaagagccgatttttcatcggcccaaacgatttatcctacatttgtttgtcttcttttttttctgagtcattttttctgatatcctgagtcagtccgcttgttgcttgtttaaattctgataaggcttttcctgctgcacggccaagcgccggcagtttatcaggcccaaatactaaaaaacccacaaacaaaataacgagtatttttgtgaagcttaattccatatccttttccccctgattgaagtacaaccttttaaacaaattataagagatagcagtacaaatgggaatgcatttattttgaacattttaaaaccagacaaagacggattcataaaacggctgctgctgaatataatgtccaatgccacctgcctaagaagcagggaggaaggctggatcaattatgtagctctgccggaaatgatacaaacgtatctgcggctatcattgaaatagaggagtggtgtagctgatgagattcactaaggtagttggatttttgtctgttttagggttggctgcggtttttccattaacggcacaagcagaaaaagccggaactgcgggggctggagaatgggataagttggggacttacacatatacttactcaagtccgacggtatactcgaccggaggagattttagagtgtgcctttcaggaagcactcctttttctgtttcactgcacttatatgaggatgatcccggtgacaatcctgatgattatgtaggggcaaactatttttcacccggagaatgccacacctttggcagtattggaaaatttgtagatgggagcaataacaaggccgagttctttgttaccgattactctggtaaatctaaaactgttacgttttatgattgatggactcaaattgtgaagtataactcttgggaaaaataaaaaagagagagatacctctctcttttttattcttcgacagctttacgaagccgttcatttacaatgccagtccagccgccatccatcttaccgcgaacgacggagcttttctcgtttgctttgccgatcacttcattcggctctttccagccgctgtgaataagggtaaaccctgtcttttcccccaagtcttctaattgaaaggtaacgacccatccttctgtatcccattcaaaagaaagttcagttggagcttgaacagccaaaactttacaaggggacggcccaaacggcgattgtaagtgaaattcttgtccttctttgagctgaaagtcattgggcataaaccacttggcaatgccttctgaagtagagactgtctcccagactttctgaatgggagcctccagggtaatgctttttgtaatatccggtaatgcattttcgttgttttgagccatttcgtttacctcttgacatatgatgtttttttcaattcaatcatataataactaatatgatcatgtccatagcgtgcattatttatgctagagctgctgttcaacagcgtgtcagttgccagtctgatctgtgaatgggagaattctgcatgttcgagaaagagagagatgtgtatgttgtcatttcgttcatgcttgtttgctcagccgcaacagttatgtttgaactggaattcctgttcagccaatttattttgcgatttttgttttaatagtaaatgagccattttctaaaacaggaggttttttatgcttggaaaaatcaaagcagccattgataacagtccagggaagccggccagaattatagttagtgaaaaagcgtttcagcaattagaggaagaaatgcgctttgtttacgtttccaaaccgaaaacgataatggggattcctgtggaagtttcagaacaggcagaaagcttcaagctggaattttagtttatcccagactgctaaaaggctcattttatgataattatgcaaaatggtcaggttggtttctttaaaagcatgatgaaatgttcatcatgctttttttatcgagaaaaaagacgaacataaaaaataggtatacgggaaaaataatcctattagagagaggggaactgacagatggataacatgatatcaacacttactgactggaatgtgtggtttcaagtgttaattgtatttctcgttccatatgtaatctataaagtgtttacttggattcatgtataagaaggtgcaatgatgaggtggcggagcaatcagtacaaaacacagaagcagcatatatcaggtcattcaacagctgaaaaggatcaggatgtgttaaccggtaacatcggatacgatttagaacatgtaaaaagaaaaataggacataacggggacgttcacttccgtgagcttgaaatcactcatttacatgtaaaagcggtattgatctttgttgaaggaatgtctgatcaggaattgattaataaaggtctatcagtgttagttatgaatcaacctaatcaggtaagcgatgaaattcaatccggcaaaggtactttaacttcgaaacagataaaaaatcaaatcatatcaatcggtgatgtcatagaatcagagaaaatcagtgatatcgtgttgaatgtgttcatgggttcgacagcgcttctcatcgatggaataccgcaggcctttcttctgggaactgtaaaaaaacaaaatcgaagtatcgaggagccgctttcagaagcgcttgtcagaggaccgcgcacaggctttacagaagagttgagtacgaatacagctcttttgagacagcaaggaaaaaatgatcaattaacattgcagagatttgaagtaggaacacgattaaaaaaggatttaatcatcgcttatatgaatgacattgcagatccaaaagtagtcgaggaagtaagaaaaagagtgagagggattgagatcgatcatttgccggagtcaggttacgttgaacagttaattgaggataattatttgagcccgttcccgcaagtacagagtacagaacgtcctgatcgcgtcataagcggattaatggaaggaagagtagccattctgcttgacggcactccgtttgctttgattgttccagtcactttcagcatgatgcttcaatcgcctgaagattattatgaacggtggttcccgagctcgctcatcagattgctgaggttcatcgcagcaatgataacgttattcgcacccgctttatatatatcatttatttcttttcatcctgggttaattccgaccaagctggcgatttcaatttccgggacgcgccaaggtgttccgttcccatctctgattgaagccttatttatggaagtcgcgattgaaattttaagagaggcggggcttcgtttgccaaaaccgattggacccgcaataggcatagtgggcggattaatcatcggggaagcagctgtgcaggcggggattgtcagtccaatcatggtcattgttgttgcgctcacagcaatttcttcatttgccatcccgcattatagcacaggtatagcacttcggatgcttcggtttggcgcgatgttttgtgcggcggtgtttggattgtttggagtcattatgtattatctgctgctaagcagccatgtcgtaaagctaaagagctttggtgtgccatacgcaagtccggcagtgccctatcacttaaaagattggaaagactttgttatcagaatgcctcttttagtcatgaagcgccggcctaaaatgatgaatacagataatacaaaacgggtgaagtgatgaactcgacaggatggtgataaagtctcatgttcagcccaaccagtaaaatcacaaccgctcaggcaacgattatcatcattaattatatgcttgctgccggagttcttacgctccctcggacagtaacagaacaaacacaatctcctgatggatggatttcagttttattaggcggggtcctagcggtaatagccgggatgatgatagttaaattaagccagcagtatcctaaggagaccttttatgaatactcccgacatattgtaggaaaatggctcgggcatctgatcagtattgtttttattacttattttctggcactcggtgcatctgaagtcagagtcatgtccgaaatcgtggatttttttctcctcgaagggacaccgtcttgggccatcattatgacagttctttggattgggctttattcaattacacaaggcctagatccgattgcacggctttttgaaatgatttttccgattacggtcatcatctttttaacgatagccctcatgagtttaggcatatttgagatcaacaatttgcgccctgtattaggtgatggaatcatgccggttcttagaggtgtaaagacaacgaacctttcatttacatgttcagaaattatgttcattttagtagcatttatgaaaaagccgaaaaatgcggtgaaagcagttgtgatcgggacaagcgttgtgaccagtttttatatgattacgatgattatggtcatcggtgcactatcagttgagggagttgtgacgagaacatggccggggcttgacctgatgagaagttttgaaatacctggtttaatatttgaacggtttgaatcatttctgcttgtgatttggattatgcagctttttgccacgtttattatcactttttatgcagcttccctgggagtctcacaagtttttaaaaagaaacccctttcatgtatgtttgggctgcttcctgttatatatatcctctcttgcatgccgaaaaatgaaaatgacgtctttatattgggcgatacggtcagtcatatcgctttgtatatatttggcgctttgccgattttgctgttagtcatttcgaaatggaggaaaagaggtgaaaagtaaactaaaacgtcaattgcctgctatggtcatagtatgtctgctgatgatttgcgtaacaggatgctggagcagtcgggaaatagaagatctcggtctcacattcgctatcgcaattgataaaggaaaagaaacgaacactgaaaaagagttaaaagaagagggcgggagctatccgaaaaaagacaacattacgctgacctatcaatttgttaatgaaaaagcggcaggcgcgggcacaagcgggggaggcggtagcggacaaggagcgcaaaaagcgtacattaatataagtgaaacaggggattcattacagcagatcggaagtgaggttgcattaagacgggaccgagaagtgtttagcccgcatttaaaagttgttgtcatgagtgaagatgtgctgcacacatttcctatcgacgaaatgctggatcaattttttcgtgataatgaaatcaggctgagttgtcttgttttatctgctaaaggggaagcaagagacgctctccagctgaaagagaacggagaaatcccggcttttcggctgattggattaggtgaaaatgaacataaagtttccagaatacttccccctataacactcgcgaaactaattggaaaactgcattctggcagcagttttttactgcaaaatgtggttgcggcaaatggagcggtcaagtattccggagcagctgtaatcaacggaaaatcgaaaaaaatgatcggcactttaaatgaatatgaaactgaggggattacatggattagaggagaagggaaaggcggagttgtcaaaagtcatgataaaaagagccaacagacattagcgtacgatatcaataaaatcaaaagcaaaattcagccaatcgtaaaagggaaagatatttcattccatgtcgatattgaatcagaaggcgatttggttgaaaactggaacacaaaagaggcgttggacacccagtttatagatcgtctcgaaacgactattgaaaacgaggtaaagaaaatagttggtcaggtattaaaaaaaattcagcatgattataaagcagatgttgcgggttttgatgaatcttttagacttacatatcctcacttatggaaaagggtgaaaaataactgggatgacaccttcagtaaagccgacatcacatacagtgtgaacgtcacaattactcatttcggcacggttaaaactcagtaatgaatcccaaggaagagaaggaaacctctcttctcttttttatgcattttttaggatgaagatactttttttggagagatatacacttttcaaatcgaccaatatgctaatataggaattgcttgaaatagaagggacaaggggctgtgaggcagaaaccgatttatgtagaaatcgaaatgaaatctgatctggatacactctgggaatatacacaaaacccatcactgcataaggaatgggatctccggttttcaaatattacgtatttgaatagtcagccatgcgaaaaacagaagtttctttacgaaacaagggtaggctttggattaaaggtgtcaggtacaggagaaaccgtcggtgttttcaacaaatgttcatctgaaaggtcttcttcactggcttttggctctgatcatccattatctctgattcggcatggaagcggctactggaagtatatacagagagaaaatgggaaaatgacgtttttaacacagtatcaatacaaaacagcctacggactgccgggaagatggattgatcgtttattatttcggccgctgcttggctgggcgactgcctggagctttgatgcattaaggctttgggtagagcaaaataaacatccgaagcgcttcattcgatctgctatcatctatgtgttcatgtgtctgtttttcagcctgttttggttctatcaaggctttgcaggtgttaagacaagcatattggcaggaacagcggagataggcttagctattttgtggctgcttcctttaaaaagaaaatggatcattcatggtgtccaggcttgtatttttgctgggtttgcttgtctaggttccgaaatattcatgtgggttctgttgagtgtgttttccgctgcaagcggcgctcttagcctgcagctccccagtgccaggcgcacaaaacgaaagagaaagaagtgacattgtgagttcgatttatgaaaaatcaattattaactatcatttgctgcatcccaagctgcagaaacggtaccaattagacgggtctcatacattcagcgggacgggaacgatgtcagaaataagcggaggctcttttctggttagaatgctgttaaagctgggtgtttttttcagatgcttcttttcagaaagaggcaaagacattccatttacaatacaaaatagaacttgtcttttgaaatcgcaacatacaggaatagaatggaatcgtacatttttctttaaaggcaaaaaacgtttctttgatgcgttaatgatatatgacgagaaagaaaatagaatacttgatttcttcggcaaacctcatctgctgctgtctgttttgacgttcgaggcatctcatgacggctctcttacgatcacatcgggaaagcaatggctattaatatgcggaaaaagaatcccgctgccgaaatggctgaccggtacatccgtagtttgcgaaacgtttgatgaaaaaaagaattgtttcaccattgaagtgcatgtgcaaaatacaattcttggcactcttttcttttataaaggaacgtttcaggaggaagagagagaatcatgaaacgaaatggcatagtcagtgcgctttgttttattggatttcttgcagcagaagcaccggatatttcagtggcagaggcactcgttttgttatccattctatttttcgtgccgggaatttttccttttgtttttcgtcaatctccggttcgtgctgctcagtttatggaatatgggctaatccagtggtatccggcagccgcattctttgcggtgctggctctagtgacggaggttgggggtttcgcacttatctggtggatgtacacagtttttattgcattgtatgcgatcctccgcctttgggaaacaaagatacatagaatcgaagagacatcagttttgttcggccttatttatttggcgggaggaggattttggttttttgcttatgctgcccatttgcagatcatgcaatttggccctctcatcattttgctgactgctgtccactttcactattctgcttttctgatcccgatcttcaacggtttactcggcagaaccattagaaaacatcggatgttgtacagttggataacatgggtgatttttctttcgccccttcttatcgcactgggcatcacatattcaaaaacacttgatgtcattgcggttagcatttatatggcggcgatttatcttcatgcatttttggtgttcacggcagcttttcgcaccaagacggggacatttcttattcggctttcttccgctgttttaatgataacgattgctttctcgatgatttattcatttggtgtatttcggcaagaagttacattgaccatcaatcagatgatttggattcacggttttgtcaatgcgtttggtgttatcttgcccgctctcatagggtggagaatagaggatgcgaaaccttttgatgcagacagtgtaaagacattcagccgtatctacggaaaaagaaagattggagaagaatttttagctaacattcaagctgaaaataacgctcggtacagcggacttgtggatgatatgggcagcctgcgttcaaaagatttttcaccagaaaaactggagccgctcattctttcgttttatgaacaaaccatcgaatacaatattaaagcaaaagtaacatggagcacgtggtttcggccgcttgcaattatttacgaatggttcagcagaagaatcggccaaatacatctttcgacgaaccctgactggtataggatgtacagcaagataagaggtgttcattctaaaaaagacggaagggaaagagtacgtgcctggattagaacaaatgaaaaaaacgaaaccatttttaccgctctttattcagtgtatcgttcaaatggagaggggtatatgaatatttctttaccgcttccattcagcagcatgacaggtattttaaaaccatatcatcaccaggagaagctggttttaacaagcaggcggagaaaaagcagagcgggggatgagggaatttatctgcaaacaagagcgggaacttgtccgcttcctttatctgaaacctttctgatagaagctgcacatgacaacaaattaaccgctgttcatcatatgtggctgtttgaaataaaatttctaactgttcattacagcattacacatattaaccagcctattgaaagaacctaacacaaagaagaagcttcgtctgccagttgctgcatttcaaaattctgcaccgcatcaagacaggaaaggaagggtttatggtgttttatatcagtttatttctgattctttggctggctgcggggtttgcagtgggaatgaaacaagtgtatgtcgatcagctgtttgataaaactgtgatcgaaaggctggaaaaagaagcgaatgatcatggacaagctgaccggatgatcaaacagcgcgccctttatattgcagcagtgacattaagcgggtttatttctgtttattatgaaatgaaaacaatcccgcaaaggcgaaacataagaaaaattgaaaaaaacatcatgaaattaaatcaagtaaaaaaacgaagaatgaagagaaaataaaaatgcacaggccaaagggcaggtgcatttttgttttgtatggaaatgggggaggtggtgccagcttacttttcataaattcaaaaatgagaagaacagcgcccgggctaatggtatataatattgtgaatttaacaaaaatttaacaaggaggacgagagaattcgtgcttaagcctcaaagagacctacatcctgttgatttggacttagaggcggagtagatgaaaccggccaaagtatccctgctccgccgtttgctccattccttgaagcatgttgattgtaacatagccaaacgttttccatcaactattaaaattgtaaaattattgtttatttttatggtatttactccgatttcttcaatttctgctgaagatgtataccagaattttgaggaattaaaaaacaatgaagatccttctgattacgacgttgttacgaaagaaaacggaagccctgttcttgttttagccattcacggaggaggtattgaaggagggacaagtgaagtagcgagagagctcagcaaagagtactcgatgtatttatttgaaggcttaaaatcggcaggaaactcagtcctgcacattacgagcacgcactttgatgaacctcgggcccttaaaatgacgggaaatcatgaatatgtcatttcattacacgggtacgcagaagaagatcagcagatcgaagtcggcggtacagatcgcgtaagagcggcagatttagttgagaaattgcagcatgccggttttcctgctgtattgctcaatacggaccatccacatgcgggcgttagtccgaataacattgcaaataaatcaaaaacaggtttaagtatccagatagaaatgagcacaggctttcgaaagtctttgttcggcatcttttctttaaaaagcagagctgttactcaaaatgagaggttttataagtttacagaagtgatgttccgttttctcaaatatagctactgaaaaataggaggcgataagacagcctcctattctttatgcttctcattcgtttcgggaaacagctcgtccgcggcttccgtttgatactgcaacgtgttatctctcgctgacagttcatttcggaaattttcatcaagtacatttttcaataaataccgatgaaaaaagaattcaaaaacagtaagacaggcagcggaaaggagagctgctccaaatggtgagaaatcgtttcttgtttgggttaaaacaaatacccaaagaataacgaatgaaaggccaaagtcagccaatgaagctgtaatattgtttgttctgggtaagacgagcatgtcaccagaaagataggaaacaaaacctaagaaaagtgcaataaacatcacacttaagaaggatgcgtgatagactctgtccaaaatcacatataaaagggcgagagtgaaagcaatctttgaagcaagcgcaatgatatgtttcatttgaccacctaaattgttattttttgaagaaaattcttgggcgtaaacaaatgataaataatgcaattcaaaaccattcataatggtcatgttactattttaaacagtccgtttttgtttacactggtattttttttcagcagtatgaaactttcttatgaaaaaagacgtatatgtggatgatcagctttcaaggggggaatgatttgtggagataaaaggaatcaatcacttgctattttcagtttcgcatttggatacatcgattgatttttatcaaaaagtgtttgatgcaaagcttttggtaaagggaagaacaactgcatattttgacatgaacggcatctggctagcgcttaatgaagaaccagacatcccgagaaatgacattaagctttcttatacccatattgcttttacaattgaagatcatgaatttgaggaggtatcagctaaattaaaaagacttcatgtcaatattctgcctggcagagaacgagatgaacgcgatcgaaaatcaatttattttaccgaccctgacggccacaaatttgaattccataccggaacccttcaagacaggcttcgatattacaaacaagaaaaaacgcatatgcacttttatgatgaaacggccttttgacatcacacaccatatttcatataaggttaaatttaaagaagggtgttggtggagactttatgtttggagaaggtttctacccgattagttcaacgatgccatatcttttgaactgcacaagtgattccgtgaaggagaaattgaaatacatattacattttatatgaagaaagcgagctgttttaacagaaagatgaactaattagactgtgtactaaattttcagtatatttcaattacctcgccccttaataaatatgaaaccgtatccttccacgacctaaaaaatgaaacgtttttaagaagatggcgtctaatattttaaatgttcatattttgataaaagtttcctaaaggaaagaaaatttcttgacttcaacaatcttttggtggataattgtggtgtaaacatgatgttctttttcctcctattcaggctcgcacccaaaagtcagggcgagcctgctttttttgaacaacaaaccccctctccgtaaaggaagagggggttattttatgcatctgatagatcaatagattaatggacggttctgaacacgccaatcactttccctagaatgctgacattctgcaaaatgataggttccatcgttgggttctcaggctgcaagcgaatgtgggtatcctctttatagaatcgttttacagttgcttcatcatcttctgtcatcgcaactacaatttccccattgttcgctgtgttttgctgtttaacgatgacatagtccttatcgagaataccagcatctatcatactgtctcccataatctccagcataaatacatgctcgtctggaggaaccatgcggtctgggagcggaaaatattcttcaatattttctactgctgtaataggagatcccgccgtgactttcccgatgaccggcacattaacgacctggctttgcggaatgtctacttcttcatcaagaatttctattgctcttggttttgtcggatcccgtctgatcagcccttttgtttccaagcgggccaaatggccgtggacagtagagctggacgcaagcccgacagcctctccgatctctctcacggaaggcggatatccttttgatttaacctctgctttaataaaacggaggatatcaagttgcctttttgatagcttcgtcatttttcgcacctcaaaacgtcgattttaagaagattatagcatgattttccttacagtacaaacataggttcgaaaaaacaattgacagaaacgtttgttcgtatatactgaaattataaaaatgcgaacaaacattcctgttggaggttatgatcatgagtaaagaatctattatttttgtcggtctgttcacagtgattttgagcgcggttatccttatgctgtcatatacaagcagcggccaagagcttaatcagtatgttaaaatagaagtccagcaaggcgacacactctggtcaattgctgatcaggtagcagatacaaaaaagataaacaaaaatgattttattgaatgggtagctgataaaaatcaacttcaaacctctgatatccagccgggtgatgagttagtgatcccattgaaaaagaagcatcaggatgcatatgaattagcaactgtaaaatagagaggaaagagagataaaatgaaagcactcatttatgcccgtgtaagcacaaataaagaacagcaggaaacgtcattaaagcggcaggaggaggagcttacggccattgcagcggagaacggtatggaagtggtcaaagtgattttagaaaaagccagcggatatgaaatggatcgggatggtgtatttgagctgcttgatgagattaagaacgctggaattgatgtcattttggttcaggatgagacaaggctcggacggggaaacgcaaaaatcgcactgcttcattgtatttatagagaaggtgtgaaagtctatacaacggctcatagaggtgaactggagttatcggaggctgactcaatggtcttggaaatcgtcagcattgtggaagagtatcagcgaaagattcacaacatgaaaatcagacggggaatgaaacgtgcagtaaaaaacggttttaaaccgcaaaaaaacttaaaaaaccaacatgggaacagtggaaaagaaaaaatagaggtgccaatctctgagatcgtccgcctaagagcgaataaactgacgtttgctgaaatcgcggctaccctaagagggtttggctatgatgtctctaaagcaactgttcaccggcgttttcaggaatacatagagaatgaagagacagcagagtgaatcagttgtaaaactttttttgatctagtactatatagacaaaatgcaataaaggagtttaacatgatttcaaacgcgaaaattgccagaattaatgaacttgctgccaaagctaaagctggcgttattacagaagaagaaaaagccgaacagcaaaagctccgtcaagagtacttgaaaggttttcgttcttctatgaagaacacgttaaaaagtgtgaaaatcattgacccagaaggcaatgatgttacaccagaaaagctaaaaagagaacaaagaaataacaaacttcactaatataagaggaatacggcaatatcgtattcctcttttgcatatactataatcaaaactcttatgtgacaaaattcaacaagtttctctcaaatttaagctgaaacagttgagaaaaagtcgtcagacatttatgatgtaagggtacaacacataaggaaggggatttttatggatacaattgaaaagaaatcagttgctaccattcgcacactgtcaatagacgctattgaaaaagcaaattctggtcacccagggatgccgatgggagccgctccaatggcatacacgctgtggacaaaatttatgaacgtaagtccggcaaaccctggctggtttaaccgtgaccgttttgttttatctgctggacacgggtcagcactattatacagcatgcttcatttaagcgggtttgatcttagtattgaagatcttaagggattccgccagtggggcagcaaaacaccaggacatccggaattcggacatactgccggtgttgatgctacaacaggtccgcttggccaaggaattgccatggcagtcggtatggcaattgctgaacgccatttagcggaaacatacaaccgcgattcatttaacgtagtcgatcattatacatacagtatttgcggtgatggtgatttaatggaaggtatttcttctgaagccgcttcactcgcaggccatcttcagcttggccgtctgatcgtactatacgattctaatgacatctctcttgatggagacctcgaccgttcattctctgaaaacgtgaaacagcgttttgaagcaatgaattgggaagttctttatgttgaggatggaaacaatattgaagaattaacagcggctatcgaaaaagcacgccaaaatgaaaagaaacctacattaattgaagtgaaaactacaatcggattcggttcacctaaccgtgccggtacatccggtgttcacggtgcgccgcttggtaaagaggaaagcaaattaacaaaagaagcttacgcatggacatatgaagaagacttctacgttccgtcagaagtttatgagcatttcgctgcagctgttaaagaatcaggtgagaaaaaagaacaagaatggaatgctcaattcgctaaatataaagaagtttatcctgaacttgctgaacagcttgaactggcaatcaaaggagagcttccgaaggactgggatcaagaggttcctgtgtatgaaaaaggaagcagcctggcatcccgtgcatcttccggtgaagttctcaacggacttgcgaaaaaaattcctttctttgtcggaggttctgctgacctagcgggatcgaacaaaacgactattaaaaatgccggtgattttacagcggttgattactcaggcaaaaacttctggtttggtgtacgtgaatttgcgatgggtgcagccttaaacggtatggcgcttcatggcggtcttcgtgtattcggcggaactttctttgtcttctctgattacctgcgtcctgcgattcgccttgcagcgttaatgggccttcctgtgacatatgtcttcacacatgacagtattgcggttggtgaagacggtccgacgcacgagcctgttgaacagcttgcttcactccgtgcgatgcctaacctttctttgatccgtccagcagacggcaatgagacagcagcagcatggaagcttgcagtgcaaagcactgaccacccaacagcgctagtgcttacacgtcaaaaccttcctaccatcgatcaaacagctgaagaagcattggcaggagtagaaaaaggtgcatatgtcgtttctaaatctaaaaacgaaacacctgacgctcttctcattgcctccggatccgaggtaggtcttgcaattgaagcgcaggctgaattggcaaaagaaaatatcgatgtttctgttgtcagcatgccttcaatggaccgttttgagaaacaatctgatgaatacaaaaacgaagtccttcctgcagatgtgaaaaaacgtcttgcaattgaaatgggctcatcatttggatggggcaaatacacagggcttgaaggtgacgttctcggcatagaccgattcggtgcatctgctccaggtgaaaccatcattaacgaatacggcttctcagttccgaacgtagtgaatcgagttaaggcattaatcaataagtaagcttttgaaagaggatgagtcaaatcatcctctttttcttgtttatccgacaaaaatagtattggctgtttaacagtaatagacaattctttcttttcttcttttgtataatagagagcaaatgaaatgctgctggaaaaggggatgaaaagatggaacgtcactactatacgtacctgatcaaagaggaatttgccaatcactatttcggccgggaatcggttatgtttgagctgtttcaagactatcattggacaagccttgaaaagcagcagtatgaaatgacagagaaacagattcaatatattacacaaccaatcccgattttacatatgcatcagcggttaaaaatgaatttaaacaagacggattacaggcagctggattatatttatagaatagctttgccgaaagcaaaaggccacgcgacgtttatgatgaaggagcacatgatagaaattgtggcttcgggagattacgaggcagaaacgatattctttgaagtgttaagaaaagtaagcccttgctttttagcaatggatttcaattcgaagcgttacggatggctaaatccggtgaaagaaagaaattttgtctaaaaccgaagaaaaagagatgtaaatgttgtataatagcttttggtttagtacactttaaactagacaacatgaaggaggaaataaaatgactttatgggttggcatcctagtgggcgttgttgcattgctcataggtgttgcactcgggttttttattgctcgtaaatatatgatgagctacctgaaaaagaatccgcctattaatgaacaaatgttacgcatgatgatgatgcaaatgggaatgaaaccttctcaaaagaaaatcaatcaaatgatgaaagccatgaataatcaaacgaaataatacgtaaagattatgatatagagaaacatggttataaaataaaaaacccttatacgggttttttattttgcaatcattcatcacccgctactgctcgaaggcgctgcttttgatattgtatgagaagatggtcaagctcctgactgagctctatcgtaatatgagatgtcattccgttcgccatgacaatttgcagcagctctgctctttttttttcaatttcttttaatagatgctctctaatcacagggatgtatcctttcatacattagatcttcaaagtgaatgtttatattatatccatatttatactaattttcaaatgagaaggagtataatgtctcaatgtcaaattaaattatataagttttttctgaaaatagaaatccttcaagtgaaagtgttaaaaaaatgaaatgattttgtcataacttgaaggaatgtcaaatcatgaagggatgatgacatgggagacgtgaattattttttgacattcggtgcgggttttttatcctttatttcgccttgctgcctgccgctttacccagcttttttgtcatatattacaggggtcagcatggacgatgtaaaaacagaaaagctgctgctgcagaaaagaagcctgtttcatactttgtgttttttgcttggcttttcagtcatttttattgctttaggctatggaacatcttttattggcagcctgtttagggattatcacgatgcgattcggcaaattggcgcgttgcttattattttgttcggtttcattacactcggtgtgttccggcctgaggctatgatgaaagagcggagaatccattttaagcataaaccaagcgggtttttaggatcggtcttaatcggaatggcatttgcagctggatggacaccatgtaccggtccgatattaggtgctgttatcacacttgcaggcaccaatccgggctcagcggtgccatacatgatgttatatgtactcggtttcgcggtaccgtttcttttattgtctttttttatcacaaagctgaagtggataaggaagaaccagcttttcattatgaaagctggcggcgttttgatgattgtgattggtgtgctgttattctttaattggatgagcctgatcattattttgctgtcagatctttttggaggctttactggtttttgacggtaaattactttcgtactactactaatccttttgtttttggtacaataagactattatctgtggaaatcgattgttggaggggaatatgacaagagttttagttgtagacgacgccaagttcatgagagtgaaaatcagagagatcttggaagaggcaaattacataatcgcaggcgaagcggcggacggtgaacaagcagctgacctgtataaaaaactgcgcccggaccttgtgacaatggatattacaatgccggtgaaaaacggcataaaagcgcttcgtgatatcttaacctttgatcctaaagcgaaggtcatcatgtgcaccgccatgcgccagcaaagaattgtaacggaagcaattgagctgggggcaaaggattttattgttaagccgtttgaggaaacaaaagtgctggaagctgtaagccgcgttatgggacattaaagtcatttcttttcaaaatggttttttttattgttttggagtatagtatatagtatcaacactccgagaaacaaaggaatgataagtatgatgattatagtttcatcgattattgctgtgttaatggctgtagctgtgatggtggtcagaataaagtcctctgacaagcctgtttcaccaaaaaaaatcattctcccgccgatttttatgagtacgggagcgttaatgtttttatttccggtattttgggtaactggtgcagagtttttggaagcattcactttaggtgtgattttctctatttttctaatcaaaacttctaagttcgaaattaaaaataatgaaatttacatgaaacgctctaaagcatttgtttttatattagtcggtcttttggtgatcagaatcgtgatgaaatcgatcttgagcacatcaattgattatggtgcactgagcggaatgttttggattctggctttcggtatgattgtgccttggagaatcgccatgtatttatcatatcgaaaacttcataacgagctgcagtcatctaatattcaaatgaattaaaaaacctttcctcttgtcaggaaaggttttttatttgagaagggtctgataaggttccaaatcgatttttttgtcccgcagatgcctttttaagaaggtatggtctcttttaggagttgcgagaatatagcctttgatcataagttgctgatcaatctttgctaccttttcttttaatgcaagctcaccgattttgcctgcgattttagcttttgctgcatctctgaacagctctggcacgggcgcagtcaattcatctagaaactgtttgttttcatcgttccataaatgtctgctgttttcaatatagtaatcctgccaatcaagctctgatctgccgtcctcttttggtaaacgctttaaaaactttcgaaacatgaaaaaaccgccgattgataataagactaccatcatgatcacccaaaacagaataaaccataaaaaccatccttccagcatcaatcattcccccttattctaaccatattgtatacgaagagagattagaagaacacagtaaaaaaagaatagaaaaaagtgatagacgtctagtcaaaagagatagtagatcatattctattgtatagtgaatctgctatttggccatgggagagtcactagagggtatttgacgataaatggacggaaaaaaaagtcactttcataataggggatgaaagtgactttttatgtttagctgagaggaaattgaagagaaaaagaagagccatcttctgtttctttattgacggcgactgtgagtatttgattttcgcattcggcttgaatggttttgtcattaaaataaaaaggaagcatcatttgtttttcaaaagtctgtcctgacgatttgactgttaagatgaactcgcatccagaaagggtaactgttacttgtgtaggctgtaaaaaagtcagatccgcttctataatatactgctgacttgtttcatataaatcaataggcaatgtttcgtcgtaccaggcgaaggggtcttcaaaaaattgccgaagccattcatccatactatcgaaatcattcgcatcgttgcgttttgaatggttcatggaagcattcctccacatatcaaccttgctttacatcatatgcggtggattataaatgggtgaacgcataaaaaaacagacactaaggtctgcttttcttacatatcatggcttgagttgtgcttttgtcttgtatggtttcggttctttacttttttgcttccgcttagaggctcaggttggccgggattgtgtcctttaggggcgtttttatgcatatctttacttgtattcttattggtcataaaatgagaacctccttaaaagagttcggtgttattgattggtttttctttttttgttattttggcgttctgcttcagtcagtacaagctggtcgttttcaatatagccggcgcctttgccttggctttttgcgtcattcattccgttaatgacgtgattcgcttttcttttgaccatcattatcacctcaatcataatatggcttcttttattgtgttatatgagagagcgtaaacagtaaaaattaccggtacatttttctcataagtcgaacttattgtatttaataaaaacattgatatttacttatgtatgattttgttttaatatgaaattgtgagaaaattgtgatggaatgtaatgttcatctgagaatgatctgatctgaagggggattttggagaatggcaaacgagcaaaaaactgcagcaaaagacgttttccaagcgagaaaaacgtttactacaaatgggaaaacatatcattactactctttaaaagcgttagaagattcaggtataggaaaggtttcgaagcttccttattccatcaaagttcttttagaatcagtattgcgtcaagttgacggcttcgttatcaaaaaagaacacgtggaaaatttggcaaaatggggaactgccgaattaaaggatatcgacgttccgttcaaaccgtctcgtgttattttacaagacttcacaggggttccggcagtagtagatctggcttcactgcgtaaagcaatggcagctgtcggcggagatcctgataaaatcaaccctgaaattcctgttgatcttgttatcgaccactctgtacaggtagataaagcgggtacagaagatgcattagcagtaaatatggacttggaattcgaaagaaatgcagagcgctacaaatttttaagctgggcaaagaaagcgtttaacaattatcaggcagtaccgcctgcaacaggtattgtgcaccaggtcaaccttgagttcttggcaagtgttgtccatgccattgaagaagacggcgagcttgtaacgtatcctgatacgcttgtcggaacagactcacacacaacaatgattaacggtatcggtgttctcggctggggtgtcggtggaattgaagctgaagcgggaatgcttggacagccttcttacttcccagttccagaggtaatcggcgcgaaacttgtcggcaagcttccgaacggaacaacagctactgacttggcgttaaaagtaacacaagtgctgcgtgaaaaaggcgttgtcggtaaatttgttgaattcttcggaccgggaattgctgaactgccgcttgcagatcgcgcaacaattgcgaatatggctccggaatacggtgctacatgcggattcttcccagtagatgaagaagcgcttaactacctgcgcctgactggccgtgatcctgaacatattgatgttgttgaagcatactgcagaagcaatggcttgttttacactccagatgcggaagaccctcaatttactgatgtggttgaaattgacctgtctcaaattgaagcaaacttatcgggtccaaagcgtcctcaggatttgatcccgctatctgctatgcaggaaacgtttaaaaagcaattagtcagccctgcaggtaaccaaggattcggtttaaatgctgaggaagaaaataaagaaattaagtttaaactccttaacggcgaagaaacagttatgaaaacgggtgcgatcgccattgctgcgattacaagctgtacaaatacatcaaacccatacgttctgatcggcgccggactggtagcgaaaaaagcggttgagttagggcttaaggtgcctaattacgtgaaaacgtcacttgcaccgggttctaaagttgttacaggatatcttgtgaattcaggccttcttccatacatgaaagagcttggctttaacctcgttgggtacggctgtacaacatgtatcgggaactcaggtccgctttcaccggaaatcgaagaagcggttgcgaaaaatgatcttctgattacgtctgtcctttccggaaaccgtaactttgaaggacgtattcacccgcttgttaaaggcaactatcttgcttcaccgccgcttgttgtggcatatgcgctggctggaacggtaaacattaacttaaaaaccgatccaatcggtgtgggcaaggatggtcaaaacgtatactttaatgatatttggccgtcaatggacgaaatcaatgcacttgttaagcaaactgttacgccagagctattccgcaaagagtatgaaacagtatttgatgacaacaagcgctggaacgaaattgaaacaacagatgaagctttatataaatgggataacgattcaacttacatccaaaacccaccattctttgaagagatgtctgttgagccaggcaaggttgagccattaaaaggactgcgtgttgtcggtaaattcggcgattcagtcacaactgaccatatttctcctgcgggggcaatcggaaaagatacgcctgccggaaagtatttgcaagaaaaaggtgtttcacctcgtgactttaactcctacggctcccgccgtggaaaccatgaagtcatgatgagaggaacatttgccaacattcgcatcaaaaaccaaatcgcaccgggtacagaaggcggatttacgacgtactggccgactggtgaagtaacatccatctatgatgcatgcatgaaatacaaagaagataaaaccggtcttgtcgtattagcaggaaaagactatggtatgggatcttcacgtgactgggctgcaaaaggaacaaaccttctcggcatcagaacggtcattgcagagagcttcgaaagaattcacagaagcaatcttgtattcatgggtgtgctgccgcttcagtttaaacaaggtgaaaatgcggatacactcggcttaacgggtaaagaagtcatcgaggtagatgttgatgaaacagttcgtcctcgtgaccttgtgactgtaagagcaatcaatgaagacggcaatgtaacaacttttgaagcagtcgtccgctttgatagtgaagttgaaattgattactaccgccatggcggcatccttcaaatggtgcttcgtgaaaaaatgaagcagtcctgatgaatcaataggaagagaaggcatttcgctttctcttctttttataacacaatgtgctgcggaggtggcatatgctgaaaaaatggctcgcagggatcctgcttatcatgcttgccggttatacgggatggaatttatatcaaacatacagcaaaaaagaagtcggaattcaagaggggaaacaagcacctgatttttctttgaaaacgctgtcaggagagaaaagctctttacaggatgcaaaaggcaaaaaagtgctgctcaatttttgggcaacttggtgtaaaccgtgccgtcaggaaatgcctgcgatggaaaagctgcaaaaagagtacgccgacaaacttgcggttgttgcggtaaatttcacttcagctgagaaaagtgagaaacaggtccgagcgtttgctgatacgtatgatttaacattccccattctgattgataaaaaagggatcaatgctgactataacgtgatgtcatatccaacgacatatatcttagatgaaaaaggtgttatccaagacatacacgttggcaccatgacaaaaaaagaaatggaacaaaaactggatcttgattagattcagtttttttatgctcagatatgcttacaagttttcagaattggaaaaaataaaagaatatgcggaggtgagaagcgtgaagaagatgagaaaacgttcttttcatgagctcgtcatggaaaacaaaaaagagctgatgaccaatacagagtatttaaatcagcttgaggaaaagcttgaacagcgatttaagcaaaaataacctttaatttgtattcatgtttacccctccttttgagaaacctatctgttgaggagggataaacatgggaaacaacaagaaaaacggtcagcctcaatatgctccaagccacttgggtacaaagcctgtaaaatataaagccaataaaggggaaaaaatgcatgatacttcaggacagcggccgattatcatgcagacaaaaggcgagtagcgaaaattcgagtttatttctaggaggtacatccgaatgacaaagaaccaaaatcaatatcagcagcctaatcctgatgatcgctctgacaatgtggaaaaattgcaggatatggttcaaaatacaattgaaaatatagaagaagcagaagcatcaatggagtttgcttcaggagaagataaacagcgtatcaaagaaaaaaatgcaagacgcgaacagagcattgaagcgtttcgtaatgaaatacaggacgaatctgcagcgagacaaaacggataccgttcttaaaaaaccagggaaacctggtttttttctttctgatttgattatggtaaaatggggctaaattgacgttaagggagcagagtaatcttgcatgtatcaaaaaaagaaatagaagtgcgttatgcagaaacagatcaaatggggattgtctaccacgcaaattatcttgtgtggatggaggtcggcagaacggccttaattaaggacttaggctttttatatagtgatatggaaaaaagaggcgttctgtccccagtcgttgatatcaatatttcctataaaaagccgcttcattacggagaaaccgcggttgtacatacatggatagaggaatataacggatttaaaaccgtctatggttaccacatctataatccggccggtgagctttccatcaaagccacctcatctcatatttgtgtggataaagaaagctttaagccaattcaattccgcaaagcttttcctgattggcacacagcatatgaaaaggccaaaaaatagggaagtgaacgggatatggcgtttggtgtgaaacgggaggaacttaaccgatggaaacaagcagtgaaaagaggagaaatcgcatttttaacacattactggctggatgaccgatttccggaagcaaggactgtaacaaaagccggctgtgcagacattgataagctggttcagtggggggcggcgtacgggttaaaaaaagaatggatccataagaaaagtgaatttcctcacttcgatctgctgggggaaacacaaaaatatattttggaacaagaaaacctaaccgatcatcttatacgatttcatttgtaaaaaaagaacgcacatgatgtgcgttcttttttattggtattcaaaaaccggttcatcagcgtcttctgaatagctgacgagaaggtcgtggttatcaaagtaccataaatcactttcttcaataaagaaggtaatgccgtcagcttctgcagtgactccagcctcttgtggggcatctttcgctacaccgagagaaaaacccttttgaacgttgctgcagcctccatagcggacgaaaaagcgaacctggtctccgctttccaaatcgagttcttctttataccagttcaatgcgtcttcgttaattgtcatattcataacagaacacccctttgttcttcatttgaattttctctattataaacgtattaggctattctgtgtcaaaagagaagttttttaagcttataaccattttactttaggttctgttttattgataattcgtttaatgttcgctcggtgtctgtatatcacaaaaatagtgagcagggtaacgacaatcaataaatacgtatcatggacaaagaaactatatataacagtatagatccctgttaacatcgatgagagagaaacaaatttagtcaagtataaaaagatgaagaataccgcaaccatcgtgataaataacaggggtgcgtaaaatagcaaaacgcctcctgatgtcgccacggctttaccgcctttaaatttggcgaagatgggaaacacgtggcctaaaaccgcaaagactcctgcaagaagcgggtgaatatcaacatgcatgagaaaaggcaatgcagttgccagtgtccctttcaaaatatctccggctatgacgaccgaaccagcttttacacccaatgtacggaatgcattggtagcgcctaagttgccgcttccgtgctcccgaatatcaattcccttggcaagcttgcccacaattaagccagatggaatgctgcctatcaagtaggccaaaataatcaataaagcaattaacatctacatttctcctttttcaaattcccttctttttattttaacatgagatgtcatgatctgatgataagtttttttgtaaagtttgcttacaaatccaatcaaacatgcatcatattttgatttctcctgttttgatcgtgtaaaataagtaaaaaaggagtgacacacgatgcaaaacccttctaaagcggaaattaaagagattcttcaaagaagcaaacgtatagcggtagtagggctttcagaccgtccggatagaacatcacatatggtttcaaaagcaatgcaggacgcgggttatgaaattatccctgtgaacccgacaattgatgaggccctaggtgtcaaagccgtttcatctttaaaagagattgacggtccgattgacatcgtaaatgtattccggcgctcagaacagcttcctggagtggcggaagattttttagagacagatgcgccagtattttgggcacagcaagggctagttaatgaggaagcataccagatgctaaaagaaaaaggcagaacggttatcatggatctgtgcataaaagtggcacacgctgtaacaaaataggtgcagaactgcaaaaatccttgtaaattcaaggatttttgctttttaattttaagatattgtttgcgtattacggtgaaacagatacaataaagcttgaacagctttttttgaataccttgtccagctgggtttcggccgttcgatttgcgaaggtctgctgctttatatataataaacaaacatacgttcttatggtgtaaaaacagcactagccgatgttttgagaagaactgattcgttagctctatgttgcgattgcaaacatattggttataatgaggagtccaaggcagtactggctcgaggcgaggtttataaaaaatatcttatatacaaatgatgtgtaacactgaaaaagagaaagacaatgttagtttttgaaaggggtttgtacgtttggctagaaaacagcaatttgattacaacgaagatgccatacaggtgctcgaaggccttgaggctgtcaggaaaaggccgggtatgtatattggctctactgacgcgcggggtttgcaccacttggtttatgaaattgtagataactctgtcgacgaggtgcttgccggccatggagatcacataatcgtcaaaatacataaagacaatagtatttctgtacaggatagaggccgcggcatgccgaccggaatgcataagctcggcaaaccaacccctgaagtgattttaacggtgcttcatgccggaggaaaattcggccaaggcggctataagacaagcggcgggctccacggagttggtgcatcagtcgtgaatgctttatctgaatggctgacggttaccattgagcgggacggttttgtctatcagcagcgatttgaaaatggaggaaaaccggttacatctctcgaaaagatcggcaaaacaaaaaagacgggaactcttacacactttaagccagatccaacgatgttcagcacaaccacttataattttgaaacgctctctgagcgcttaagagagtctgcgtttttgttaaaaggactgaaaattgagctgattgatgaacgcaatgaccagcatgaggtcttttattatgaaaacggcatagaagcgtttgttgcttacttaaatgaagaaaaagacgtcttgtctgaagtggtctcgtttgagggtgagcatcattctatagaagtggactttgcgttccagtttaacgatggttattctgaaaatattttgtcgtttgtcaacaatgtcagaacaaaagacggcgggacgcatgagtcaggtgcaaaaactgcgatgacgcgtgcttttaatgaatatgcgcgaaaagtggctttgctgaaagaaaaggataagaaccttgaaggcaccgatataagggaagggctttcagccattatttctgtccgcattcctgaggagcttcttcaatttgagggacaaacaaaaggaaagctcggtaccagtgaagcaagatcagcagttgatgcgattgtttcagagcagcttgcttactttttagaggaaaatcgggacaccgcaacgcttcttgtcaaaaaagcaatcaaggcgagccaggcgcgcgaagcggcacgcaaagcccgtgaagaagcaagaagcggcaaaaaacgaaaaaaatcagaagcgactttaagcggaaagctgacgcctgcgggttcaagaaacccggcaaaaaatgaattgtatctcgttgagggagattcagcaggcgggtcagccaagcagggaagagaccgcagattccaagcggtactgcctttacgcggtaaagtcattaatacagaaaaagctaagcttgctgatatctttaaaaatgaagagatcaatacgatcattcatgcgatcggcgggggagtcggggcagatttctcaatagatgacatcaactacgacaaaatcatcattatgaccgatgccgatactgatggcgcccatattcaagtgctgcttcttacctttttctatcgctatatgaaaccgctcattgagcatggcaaggtgttcattgcgctgccacctttatataaggtcagtaaaggaagcgggaaaaaggaaatcattgaatatgcatggtctgatgaagagatgggtgatgtcctgaaaaaagtcggcaaaggctataccattcaacgatataagggtcttggagagatgaacgcagaccagctgtgggaaacgacgatgaatccggagtcccgcacacttgttagggtcaaaattgacgatgcggcacgtgtagaaagacgtgtgacgacgttaatgggagacaaagtagagccgcgcagaaagtggattgagaaaaacgtcgctttcggcttagatgaagaaagcaatattttagaaaatgaaaacttatcggtcgctgaggaggtttaatgattgtcacagccagaattatttcatgatttaccattagaagaggtgatcggcgaccgttttggacgctacagtaaatatattattcaagacagggcgctgcccgatgcgagagacggattaaagccggtacagcgcagaattctgtatgcaatgcatacagatggaaacacgtttgataaaaacttcagaaaagcggccaaaacggtcggtaacgtcatcggtaactatcatccgcacggtgacagctcggtttatgaagcaatggtgcggatgagccaggattggaaagttcgtaatgtgttaatcgaaatgcatggaaacaatggaagcatcgacggagatcccccggcagccatgcgttatacagaggcacgattatctccgattgcatctgagcttcttcgggatattgacaaaaacacggttgaatttgtgccgaacttcgatgatacaagcaaggagcctgtcgtactcccggcgatgtttcctaacctattggtcaacggatctaccgggatttcagcaggatacgcgaccgacattccccctcatcatctgggagaagtcattgatgctgtcattaagcgtattcaaatgccatcttgctctgttgatgaacttatggaagtcattaaagggcctgattttccgacaggcggtattattcagggcgttgacgggataagaaaagcttacgaaaccggaaaaggaaaaatcattatccgcggaaaggctgaaattgaaacaatcagaggcggacgagaacaaattgtcattactgaaattccatttgaagtaaataaagcaaaccttgtaaaaaaaatggacgagttccgtattgataaaaaggttgaaggcatctcagaggttcgtgatgaaacggatcgaacagggctgagagtggtcattgaactgaaaaaagaagctgatgccaaaggcattttgaatttcttatacaaaaatactgatttgcagatcacatataacttcaatatggtggctatccataaccgccgtccgatgctgatgagcctgccgtctattttggatgcatatatcggacaccaaaaggaagttgtcacaaaccggtccgtttatgagcttcaaaaagcaaaagacagacatcatatcgtagaagggctcatgaaagctttgtctattttagatgaagtgattgcaacaatccgttcttctagcgataaacgtgacgctaaaaacaatttgatcgcgaaatatgaatttacggagcctcaggctgaagccatcgtgtcattgcagctatatcgtttaaccaatacagatattacagcgcttaaggaagaggcagaagagctcggtaaaaaaattgaagagctcgaatctattctgagcaatgataaaaaactgctaaaagtgattacaaacagcttaaaagcattgaaaaagaaatatgcagatacgagacgctccgtgattgaagaaaaaattgaagaaattaaaatcaatctcgaagtcatggttgcatctgaggatgtatatgtaaccgttacgaaggatggttacctaaaacggacgagccagcgctcatttgccgcttccaacggtcaggacttcggaatgaaagatacggacaggatgctgcatcagtttgaaatgaatacgacagacgtgctgctgctctttacgaacaaaggaagctacatctattgtcctgttcaccagctgcctgatatcagatggaaggacatgggccagcatttttcaaatctgatcactattgaccgtgatgaaacgattgtaaaggccataccgataaaagaatttgatccgtcggcatatcttctattctttacgaaaaacgggatggtgaaaaagacagagctcacccattataaagcacagcgttattctaaggcgcttgtggccttaaatctgaagggtgaagatgaactgattgatgtacatgtaacaaatggggaaagccagatctttatggccactcacttagggtacggcctatggtttggagaagacgaagtgaatgtagttggcgcacgtgcggcaggtgtcaaagggattaacttaaaagaggatgactttgttgtctccggtgagatccttcagcaatctgattcaattgtcttgttcacacagcggggagcggtaaaacgcatgagtctttctgagttcgagaagacatcccgcgcaaaacgcggtgtcgtaatgctaagggaactgaaaaagaatcctcaccgtgttgtagcactgttcgcttgcggtcttgaacagcgactaatggcagaaacagaaaaaggcgacagaaaagaactgcaggcaaaagagttgcggacaaacgacagatacagcaatggctctttcttttttgatgaagaggaatcaggcaaggttacagctgtttggcgacttcatacagaacaataataaaaaacccgctcatatagtatgagcgggtttcgtttgttttttatcagctttcatggttggtgaatagatctgttacagcatgaatgacttcaatcccctgccatacaaataaattcagcgctgtgaaagaaaataagcctaaaatcaccattcttaagataaacaacatgtttaacagcctcctcatattttcgttacataatcgggtgatgttgaacatgaagtttgccgaaataagacgattgataaaatttggccagtataaagctttttttccgctgacgtctgcgggagtatcccgtacttttgctttcagcggtcagcagcagaacagccattgcccataaagcggtcagcgtaaatgcccctgtgatggatttcttctcatcatcagcattttggccgactttcatctcatgcatttcctgctggtcggctacggctttataatgatggccgatatcaaaggcgtggggaattgagaacaaatgaaaactggcaatcgccaagaataagatggatgctttcaatatcgttacttttttcaaatgatctccccctcctttaatattactgaatatttttataataataccccaatccatcctaaaagtaaacgtgatttattaaatttaaaaataaatttaaccttgttaagtatatatctttttgcttatttttgaaagagaaaacttcttttattagcgtatgtatacccggtttatggtgtgaataaaaacatattttaaatgatatgtttgttgtttagggtttattactttatttatgtgttaaatcaaagggaaaggcaagagaatgggaagaaatgattacattgttaatagggcactcttttttaaaagccagcttgcaaggaatgtttttattcgtaggaaaataatagagaaggggtcgacagagtaacatctggctacgacaatattcttctcgaaaaaacttcctaattcgtcatattgtgatataataaaactcgttatgttaaaaaatctaacatcaaaatcgaattcgtgttgaattgatgaaaacgggaggtaaatatggagtcttttttcaatagtttgattaatattccaagtgatttcatctggaaatacctattttatattttaatagggcttggattattttttaccatacgttttggttttatccaattccgttattttattgaaatgttcagaatagtaggggagaagccggaaggaaataaaggtgtttcatctatgcaggcattctttatttcggccgcatcccgagtcggcacagggaatttgactggtgtagccttagcaattgcgacaggcggaccaggcgctgtattttggatgtgggtagtagctgctgtaggtatggcttcaagttttgttgagagtacgttagcgcagctttataaggtgagagacggggaggatttccgcggaggcccggcctactacattcaaaaaggtcttggagccagatggcttggcatcgtttttgcaatcttaattaccgtctcattcggcttgatttttaacgctgttcaaacaaatacaattgctggagcattggatggcgcattccatgtgaataaaatagttgtagccatagttctggcggttttaactgcgtttatcattttcggcggtttaaaacgtgttgtcgctgtttcacagttaattgtgccggttatggcaggcatttatattcttatcgctttatttgttgtcatcacgaatattacggctttccctggcgttatcgctacaattgttaaaaatgctttaggttttgaacaagtcgtcggcggcggaataggcggcatcatcgttatcggtgcgcagcgcggacttttttcaaacgaagcaggaatgggaagcgcaccaaacgcggctgcgacggctcatgtatcccatccggcaaagcaaggctttattcaaacattaggcgtatttttcgatacatttatcatatgtacgtccacagcatttattattttgctgtacagtgtaacaccaaaaggcgacggcatccaagtaacacaggctgctcttaaccatcacattggaggctgggcgccgactttcatcgcagtcgcaatgttcttgtttgcattcagttcagttgtcggcaactattattatggcgagacaaacattgaatttattaaaacaagcaaaacatggctgaacatttaccgtatcgctgtaattgctatggttgtgtatggatctttatcaggcttccaaatcgtttgggatatggcggacctctttatgggtatcatggcgctgatcaacttaattgtgattacgctgctgtcaaacgttgcttacaaagtgtataaagattacgcgaaacaacgtaagcaaggacttgatcctgtgtttaaagcgaaaaacatcccagggctgaaaaacgctgaaacatgggaagatgagaaacaagaagtataatataaatataatgaaaaagctgcattcaatagttgaatgcagctttttcattattggaaataaatttaatttttcgactcgaatgaaaaatgacgtgtaaagtcccaattcagtccagttttctttgttctatatgtgtcatgtgtgtcttattcattggaggtagagcaaattgacaggcttttaaacctcccaaaaacaagaaattaggttgatagacaatcatgagaaagatttttacaatgagttcgtgctcataagaagtgtagagccaaaatgatgcgaaggaggaaaagatcagatatgaaacggtcaatctctatttttattacgtgtttattgattacgttattgacaatgggcggcatgatagcttcgccggcatcagcagcagggacaaaaacgccagtagccaagaatggccagcttagcataaaaggtacacagctcgttaaccgagacggtaaagcggtacagctgaaggggatcagttcacacggattgcaatggtatggagaatatgtcaataaagacagcttaaaatggctgagagatgattggggtatcaccgttttccgtgcagcgatgtatacggcagatggcggttatattgacaacccgtccgtgaaaaataaagtaaaagaagcggttgaagcggcaaaagagcttgggatatatgtcatcattgactggcatatcttaaatgacggtaatccaaaccaaaataaagagaaggcaaaagaattcttcaaggaaatgtcaagcctttacggaaacacgccaaacgtcatttatgaaattgcaaacgaaccaaacggtgatgtgaactggaagcgtgatattaaaccatatgcggaagaagtgatttcagttatccgcaaaaatgatccagacaacatcatcattgtcggaaccggtacatggagccaggatgtgaatgatgctgccgatgaccagctaaaagatgcaaacgttatgtacgcacttcatttttatgccggcacacacggccaatttttacgggataaagcaaactatgcactcagcaaaggagcacctatttttgtgacagagtggggaacaagcgacgcgtctggcaatggcggtgtattccttgatcaatcgagggaatggctgaaatatctcgacagcaagaccatcagctgggtgaactggaatctttctgataagcaggaatcatcctcagctttaaagccgggggcatctaaaacaggcggctggcggttgtcagatttatctgcttcaggaacattcgttagagaaaacattctcggcaccaaagattcgacgaaggacattcctgaaacgccatcaaaagataaacccacacaggaaaatggtatttctgtacagtacagagcaggggatgggagtatgaacagcaaccaaatccgtccgcagcttcaaataaaaaataacggcaataccacggttgatttaaaagatgtcactgcccgttactggtataaagcgaaaaacaaaggccaaaactttgactgtgactacgcgcagattggatgcggcaatgtgacacacaagtttgtgacgttgcataaaccaaagcaaggtgcagatacctatctggaacttggatttaaaaacggaacgttggcaccgggagcaagcacagggaatattcagctccgtcttcacaatgatgactggagcaattatgcacaaagcggcgattattcctttttcaaatcaaatacgtttaaaacaacgaaaaaaatcacattatatgatcaaagaaaactgatttggggaacagaaccaaattagttaagcttttttttggcggacatcagtaacgatgtccgtttttatcatctaataggaggtttgcgttgtggatgaaatactgaaacagtatatggtgctgtataaaaaaatgagtaatatgataaatggtcccgactatccaggtaaggaaaaagacatccagcatcaaaaagatcagatcgaagtttacgaaaaacagctgcagcaaggattttctacagattatgactatgatgtgtttgctgattctgttatcaaatgcgcatatggcgatatgacgctggaagatttagaagccgtttattatggattgacaacaccatttttttgatttgtcattcagcagtaaaatttcaatttctgtctcactaacttaagtatactttgatattgagacagaaatttatttattttgtttacttcctagaatatatattatgtaaactagaaaagatgaagattaaagctttgctgtttttatgtacatcctttcttcttcctgtaattcagcaacaaaataaaaaagcgatttcccaatcggaaaatcgccaattcagacactctattatttatgagtgtctttgtgctcttaacgatttacaacaaatgttgttacgctttgagctggaagatgggcccaaaaatgattgcctgatacagtgagattcgttccaggttgtagattgctgctgctgctcgtgatccatctagatacgtttgaagcagatccattctgcaaaacaaagttttggttgacccctgtgttgcttttattgatagcaacaataacgaccttgttgtcacctttataggctgacacgtaaacgttcgcattagggtttttcgttgcatcaatccttacatagccgggacgcacaaactttgagaaatgagccatattgtagccgcgtttgctgatcgtaccatcttctttcataggtccatatgatcttcgaatgtaccaccatacataagcttgaaagtccccctctaccatcgcattgtgaatatgctgtgaaacatccaatgcctcaggccatcgatccgccgagttgttatcactgtttggatagtatacttccgtcatccaaaggtccttccccgctcctttttgtttgaaaagaggataagggaattggctgacctgggtgccgtacaggtgagttccgagaatatccatattggcaagagcctgcggatcgttcaagatcgggtccgacaaattcttcaagtattgaaatgactcaggcgcaatgacgcgggcattgatcgagccggcgttttctctcataaagcgaagtatttcttgcggcgtccaccacgtccactcgtgagcgtaatcaggctcgttttggaccgaaatcgcgtaaagattcacaccattattcttcatgaaggtaacaaaatcgttaagatgctgcgcgtatgctgcgtacttgttgtatttcagccgcttagctgatgtgtcaccattccgattgaaggtctcaaccatatcacttggaggattccagggagatgcaaaaacgattgccccatgtttgaccgcactcttggcagtctccacctctttataccaattatttcgattttcatctacatgaattcttaagattgaaaatcctaactggttctgtccattgccaaaagcagtttctctttgagctgctgtaagatccccagcccaagcgggatgattcatccctccaaaaccgcgaatcacttgtttctctgcagatacattaactgttacatcactggctgccaaaacttcagtagcgcctggccctaacatgactgacagcatagtgaaacatactaatagtacacaaattgttttttttatgcgtggaatcatttattcctctccttcgtcatgtgtcttttacggtattaaaaaatctgcatggcatatccataatggcgggctgttccggtgatggcccgtacttcacccgcctcgtttttaagcggtcccattacgagtcctatctttgcgtaaactgccagtaatcaaaattaaacaagtttcctgtacctgttccggtaaatacaaagaatactttgtgcacaccggttgccccgcttacttcagtttctatttctctccacgtttgcgctccacctgtggaaggtacattcagagttccaacaagcttaccatcagcactgtcgaggcgcacttctatttttccgcctaaagtggatgctacatttgctttaaatgtcctggcaccgcccgctccgaagtctgcatttcctacagcaatccagtctccattttgaatgcttgttacatgctgattatttactggcccgccgggtgctgtggacttctctgtcaaaatgcgtccattccaagcaaacgtttcagcttctacccggttataaggattcaaattggaaagctgtgttacacctgcataatttgctgctacctcttggatggatccatctgggttatgcaccagcttattaatatggggagaacggtatcctttgccggccccgaacagagcggaactgacagtttgcgcatggtacaccacataccactcgtttttaaaattgaaaacagcatgatggttgtttccgccgcctccgaaaaatgcacccggatttttcaggaagtgccctctatatgtaaaggggcccatgggacttgaactggtcatgtagccgatctcacccgggggtttatcggccggatgtgtgccgccgaaattgatgcaataggagtaataatatgttccgttatacttgtgcaatccggaatcttcaaacatgaaaggcgcatcaattgtagatgcacttccctcaacactcgtcatatcaggccctaattttatgacccttgccgttttaggattggcccattgtccctgcgttggatttgaaccgccaggaacgcctccgccggcatacaggtaaccggttccgtcgtcatctacaaatactgccggatcaaaaagccatacaacacctgacattcctggcgtacttggcgttacgagcggttttccgattgggtcggtccatggaccaatcgggctgtctgcggtgagaaccccgatacctccgccgctgtttgcgaaataaaggaagaatttatccttgccattaatttttttaactgcgattgacggtgcccaggatgcacctgcccattttgcaattccacggcctccattagctccattggcacctgctaccggaatggctccgtggtctgtccagttcaccatatccgctgaagatatgacgaatactctattcaaattggcaaatgaattatctttaatcgttccgttgctattatattcatagtcatcacttgacatataaatgtagactcttccgttataggtcagcgcaatcggatctgctcctaaatgatggtcgataagcgggtttgaattccctatatgttttgcaattgtagtacttgtggcagcatacgcagacttcccagataagcagctcaataataaaactagaatccataaacatacgctacactttttcctcatcacttcacatcctcctttttctttaaaatgggggattttcttttggaatttgatgacaacaggtcacgaagattgcacgcataaagtagccggaagctgtttagcaatgttcccagttgttctgaaagctcatcttcatgtgtctccattctctcttttcttcgaggagatcgcaccactccttcaaaattgttcaaaaaaactttcccattcctagcgaccattgtccagaaaataaaaagacaggattgttcatggcctcccactaatcacattgaacggagattacatcattatccaagatatccctttatctaacatcctacatcattaaaaaaattgtgtatagaaacttttggaggagttagtgttcgattctacaaaggaactggatacatttattcattgataagatggggctaacactccttttatatttttatgtaaagatagttttcagacacaaaaaaacagccgtcaatgcggctgttttttcaagagtataagaactattgagcggtatacccgctttttcatgttttgttcatattttattaattgtttattcaacactgtccgctatagtaatccatatcaacaaatatgactgccactcgcatcttttatgaagggaggttcgttacgctgaaagaaaaaataaagacattaggccgtttttgcaccgtaggcgtcggcaatacgctgatagattttggtgtcttctttcttcttaccgcttgtcatgtctcttatctgccggcgcagatctgctcctatactgcaggtatcgtcaacagctatgtgtggaaccggaattggacgttttgtgtgaaaggtaaggctgacgggaaagagatcgtgcgttttctcatgattaatattgccgcgtcggggatcacctttttgctgctttatttgtttcaaaattgcggctgctcgcttttggtgagtaagctcgccgccactatcggcggaatgatgatgaattttatcggaaaccgaatctgggtatttggagattcgctgaaaaacatacaggatcaggagtgaagatgaatgagaaaaaaagtgagaaaagcggttatacccgcagcgggtttaggaacgagatttctgccggcgacaaaggcgcagcctaaagaaatgctcccaatcgtcgacaaaccagcaatccaatatattgtagaagaggccgcagagtcaggaattgaagatatactgattattacagggagaaacaaacgctcgattgaagatcattttgatcggtcggcggaattggaattcaatctccgggaaaaaggcaagacggagacacttaaggaaatgcagcagattgccgatttggccaacattcattacatccgccagaaagaaccgctcggattaggccatgcggtgctgtgtgcggagcattttatcggagatgagccttttgccgttctcttaggtgatgatattatggtgtctgaaacaccggctcttcggcaattaatggatgtatatgacgtttatggcacagaggttgtcggtgtacagtcagttctccctgaggatgtcagcaaatatggtattataaatacatcagggtctcaagggcatgtatacgaagtgaacgatttagtggaaaagccttctcctgaagaagcaccttcggaaatcgcagtaatgggacgttatgtgctgaattcttcgatcttctccgttttgaagacaattggcagaggcgcgggcaacgaaattcagctgacagatgcgcttcgtgaggtttgccgtaaggagccgatccatgcccggctgctggaaggaaatcgatatgacattggcgataagctgggctgttttaaagcgagcaccgaaatcggcttaatgcgtcccgaaatgagatctcagcttttggcctatttagaagatgtgatcaaacgggaaacgaaagaaatgctgcggtaaaaaaattgtaaccatcttgctcgtcaatcagtcatataatagtgaaaaagattaggacaggttgtgaagaatgtgggcagtttgataagcgaaattttaacatggctgacgaacatgggatatgcgggtattgcgattgggttaatgattgaaatcattccgagtgagattgtattagcttatggcggctatatggtatcggagggcacgattggatttattggcgcaattattgcgggtgttatcgggggcaccattgcccagatctttatttactggatcggtcgctatggcggcaggccatttctggacaaatacgggaagtatttattgattaaaaagcatcatatcgatatgtcggaaaactggtttcagaaatacggcgccggagttgtcttctcggctcgttttataccggttgtcagacatgccatatccattccggcaggtattgccagaatgccttttctcaaatttgtggtactgactgtgcttgctatcattccatggtctatcctgtttgtttatttaggcatacagctaggaagccagtgggatgatgttgagaatatagcaggcacttatacaacaccgattatgatattggctgttgtcgtgatagccctttattttgtgattaagaaacgtacagccatatttaaacgatagctagcggatatgcataggggtgactgacgctcccctatgcatatttttttacttgcgatgttgatttgccagcttcagattctccgctaaaaatgcgacaaacacttcatcccgcacgagcgatgcggcataatttctcttaataaaccattctgcctcttcaaacgctgcgaatgtttcgtcttgggtttctccgttaatttgaatattccattcgttgtctaaagggaaaagaaaaaatctcatttgtgcgcgattttcatataatgatccattcgcagatccctttagattatagatgttacggaaggcatccggccgtacaggatcaatacggaaagcttcagctacaaacaactcgtatacttcatcggttattgaacagccggacgcttttgcatgccctccgccgccatatcggccggcgatttctgacacatcgatgtaatcatgaatggtgcggagactgactcgttttgaccccatgctcaaaatcgcaatgtaatcgaggtgcgggttatctttccctagcctgttccccagctctgaatggtacgattcagcgtgaacgatgcctacacagtgttcgtgaacaaaggtttgtaccatttcccttttctttctgcggaggtagcgctcgattttttcgtcttctaaatcaagcagtttttcttcaaaatcatcgaagaaaaattcgtcatgcgtggaaaggcgctggatcatttttgcttcaaattcatcgattgacagcaaaaagaaaagatcattaagccgcttcgcctgtttttgatcgtaccgctcccactcccatgtatcgtattggcggacgagctctgtgaattgatctaaggcgtttgtcggtttcatgaagccattttcaacgagatagccatataaaagcgatgtcgcggatgtgagccttccatcatcgtattccacctggacaaatccccattcatgctcattcaaatgaagggctgttttatgatggtctatgagcttcactttgccccctgcatgaacatactcattcaatctctcttcgttttcttcattgacggcgagatcggtgatgaataacgcgtcctgtctgttgctctccttcgctttttctaaaaagtactgcacctgtgcgtttaagccgttgacagagttataccggacctctacgtcttttccgaacgccaattttgctacgattccgcatcctactccgtccaagtcgttatgtgaatataaatgatacacaatgtaggcccctttttatgataaactgacaattgccgctagaggtgcggcagcctttatttactattctaaaaaaccaagcgttttatgcaatggtaattagttgacataatgttgttattgtaaatatacaaaggagcgctttttttgcgctcctaagttcttgcttttacaccggataaaccggatgctttcgattggtaaatgtcatttcctttgtcatgtatgccttgagccgtttggccagctcatcacgcagcgaattggctgggataacagcatcaatgatcatttctgaagccagacggtagatattgatgtcctctttgtattcctcccgtttgctgctgataaatgcggctctctcttcttctggcagctcggcgatttttttagcgtagacagcgtttacagcggcctcagggcccatgacggcgatttgggcggttgggagcgctagacagcaatccggttcaaatgccggccctgccattgcatacaaccccgccccgtacgcttttcggacaatgacagagagctttggaacagttgcctccgacatcgcagaaatcattttcgccccgtgtctgataatcccagcctgttctacttttgtgccaatcataaaaccggggatatcggctaagaacagcaatgggatatgaaaagcgtcacataaggtaataaacttagccgctttgtctgctgaatcgtggaataagacgcctccttttaccttcggctggtttgcaacaatgccgacaggctgtccgtggattcgtgcgaggcccgtcaataattccggtgcaaataaggctttgatctcaaaaaatgagtcttcatctatgacccgctcaatcagctcatgcatatcaaaaggtccgttttgattttgcggaatgacgtcggcaagcggagttttgaagtgttttggcgggcgtttctcatgaatgggcgctttttcttgaaaatttgccggaaagtaagacaaataagcccgcgccagctgtatggcttcttcttcagtttctgcaagaatatctccgcagccggagattgagcaatgcatacgggcgccacccatttcttcaagagacactttttctccaataaccatttccgccatccttggcgagcctaaatacatggaggcgttaccgtctaccataacgacgatatcacagaaggccggaatataagcgccacctgccgcagatggtccgaaaagcagacagatttgcggaatgcgtcccgataatttgacttgattgtaaaaaattcttcctgcaccgcgtctccctggaaagacattgatttggtcggtaattcgggcgcctgccgaatcgactaaataaatgagcggacagtttaatttttcggcggtttcttgaattctgatgattttttcaactgtttttgctccccatgaccccgctttcactgttgaatcattcgccatgacgcaaacggtttggccgccgattttgccgatagcggttacaactccgtcagcgggaagcccgtctgacatacattccgcaaaaaaagcgtcttctagctcaatgtcatcgtcaaagagaagggaaagccgctctctgacaaagagcttgcctttttcccgattgctttgatgatacttttccgctccgccttttcgaatccgttcagcccgttctgttcgttccttttcataatccatcagcattgcctcccttttatattcccttgtatacggcccgtcttttttcttgaaaggcctgaagcccttctctcctgtcttttgtcgggatggtttgttcatacgctttttgttcaatcgcaaggcctgtagcgagatctgtctccaatcctttattgattgcaaatttagcctgacggacagcgatcggtccgttggcagaaatggctgcggccagttcctctgcttttggcataaggtcacaaggagccgtgacatgctctacaaggccgatttcttttgcttcgtgtgcggtcacgcgtctgcctgtataaatgaattcttttgcttttcctctgccaatcagccggggcagcctttgggtccctccagcgcccgggataatagctaaccctgtttccggaagtcccagcacagctgattcagttgcgattcgaaggtcgcatgccaatgccaattctagtccgccgcctaatgcgcttccatttatcgcagctatgaccggctgcggcaaggcatcaagtaaagccgccgttctttgaatgagagatacactttccagaacctgatcttctttcagttttatccgttcctttaggtctgcccctgcacaaaacgctttttcaccggtgcctgtgaggatgacgcaacggatgtttgagttaaattcaatttcctggataatcatttgcaggtttctaagcatttccgctgaaagagcatttgctgcctgaggcctgtttaaggtgatcaacgcaatatgttcatttttaacagtaaaaagaatagaatctcccattgtatgcgtcctcccttttatcaagatgatttaaacacctgtaaatttctgctcggcagcggtttgcccattttttcttcaatccatttggccgcagatagcagtttttcgagctttacatttgttttgatatccatctgttcaagcatgtacacgatatcctcagttgcggcgtttcctgatgaacctggcgcatatgggcatcccccaagcccgcctgccgagccgtcgaacaccgtgatgcccatttggagtgctgtgaccatgttggccagagcggttcctctcgtatcatgaaaatgcagggcaatttgattagccgggaatcgtgccaaaagagcttcaagtacagtttccacttgggcgggattagctgctccaatcgtatctccaagcgacagttcagaaatcccaaattcaaatagagcttctgaaaggcgaatgacttgttcaatggggacatctttttcgtacggacagccgaaaacagtcgagaggtaggctcttgttgtgaggtttgctttttgtgcgtcgttgtttacttgtttgagtatatgaagggattcagaagtggatttattgatgttttttctgttgtgcgtctcgctggcggacataaaaacgcaagcctcgttaatgcctccttcaagtgcattctccagtcctctttgattcgggacaagtgccgcgtacgttacccctttttctcggtcgatgccttttgctacatcgatagcatctcgaagcgccggaatccatttcgggtgaacgaaggatgtgatttcaatatacgacagccctgtccgggaaagctggttgatccaggttattttatcctctgttgcgatccaaacgggctcgttttgtaagccatcacgcgggccgacttctttgattgtcacttttttaggatatggcatggtcttcctccaaattattgagtggaattgctcagttcgagcagtacgtctccttcatttacaaagtcgccttccttttttttgacttcttttacgattccgcttctatctgcaacgatcgggatttccattttcatcgattccaaaatggctacctcctggcccttttcgatttggtcgccggctttgacgtggactttccacaggtttcctgccatttgtatgctaaccgtcatgacaactgcctcctttataggtgttgtttcaaaaagtcagtcgtgacatccccttctttaaatgcctttgttgccgcagcctgtatgagaagcggaagatttgttttgattccttctacatggtagtcgcgaagcgctgtctccagtttttcaattgcttctgttctggactggcctttgacgatcatcttagcgatcatcgggtcataaaaaggggtaacaatgctgtcttttgctaccgcacattcgtgtctgactcctttatggtcagggagtgagaacgcagtgatcgtgcctggtgacgggtagaaggtcttggggtcttccgcgtatattctcacctctatcgcatgcccgtttcgtttgatgtctttttgagagaatgtgagtgtatggcccgcagcaattcgcagctgctgctcaactaagtccaggcctgttatttcttcagtcacggggtgttcaacttgcagtctcgtattcatttcgaggaaataaaaattttgcgtttggtcaactataaattcgatggtgcctgcgttcgtatagccgattgccttcgctgcttttaccgctgtttgcccgatcttcattcttagttcatcgtctacaaatggagacggtgcttcttcaatgactttttggtggcgcctctgaacagagcaatcacgttcaaacagatgtactgtatggccgtgttgatcggccaaaagctgaacctcgatgtgacgcgcatgttcaataactttttctatatacatcgacccgtcaccgaaaaaatctgctgcgcgctttttgtttccctcgtacgctttttttaatgcttcttcattttcaacacgctgcattccgatgccccctccgcccgctgaagctttcagcatgacaggatagccgatttgacctgcggtgcggcaggctgcctctatatctccgagggattcagaaacgcccggcaccacagggacaccagcagcctccattgcttttcgcgcttcaattttgctgcccatctttgcgatgatatcaggggaaggtccgataaacacgatgttttcttgcttgcagcgttcagcgaaccggctgttttctgataacaatccatatccagggtggatcgcgtcggcatttgcttttttcgccgtctttatgattctctctatatttaaataactttcactgactctcgattctccgatcaaataagcctctgtagcggcttttgtatggggcgcgtccttgtctgcttctgaataaaccgcgaccgttttaatgccgagacggctgcatgttcggataattctcattgcaatttctccgcggttggcgatcagtacttttgtaaacatgatttcacctcattgacttgatgataggttgaacatttcaatcgttttttctcgcagtttatatttttgaattttgcctgaggccgtcatcggatagtcatccgtaaaaataacataacgcggaattttgtggcgggcgattttccctttgcaataggctttaagctcatcaggtgaaacgcttttcccgtctttcagtttaatccaggctgcagcttcttccccgaatttggcgtcaggcacaccaacgacctgtacatctaaaacagcgggatgccggtataaaaattcttcaatttcccgcggataaatgttctcgccgcctctgatgagcatatcttttaatcttccagtgatgcggcagtacccgtcttcatccatgacagcaagatctcctgtaaacagccatccgtcatgattgattgcttttctggtcgcttctttgtctttataatagcctttcatgacgtgatagccacgggtgcacagttctccctgcatgcctctttgaacttcttgacatgtcccgggttctacaattttcacctcagtatgtggcagggcacggccggttgtttcgactcttcttatgaaggaatcatttgctctcgtttgtgtaatgactggcgaggcttcggtttgtccataggcgatcgtaatgtctttcatgcccatcctttcaatcacagctttcatcacttcacttggacagggagagccggccatgattcctgttcggagcgtcgatagatcatatgcatcaaaatccggatgatgcagctcggcgataaacatggtaggcacaccatggagcgctgtgcatttctctttttctaccgttttaaggacggtaacgggatcaaattcttgcacgggtatcatggctgccccgacggatacacatgccaaaaccccaaggacgcatccaaagcagtgaaaaaacggaacagggatgcacatgcggtcttgagaggttaaagccatacattcagcgatattagcagcgttattgatgacattgaaatgggtcagcatcacgccttttggaaaccctgtcgttcctgatgtgtattgcatattaatcacattgtctttatccaggctgttcattctctcttcaagctcagcatctgtcactgttttcgccaatatctctgtatcgtcccaatgatacatgccagacaatcgtttattgccaatatagatcagcgtttttaaaaagggatagcgttcagatttcagttggccgggctttgcttcttgcagttctggaattaaactgttcacgatgtctggataagaagtgcccctgtatgaatccatgataataagcgccgcggcatccgattgctttaacaagtaatcaagctcgtgtgcttgataattggtattgacggtcacgagcacggctccgatcttcgcagttgcgaactggacggcaagccattcagagatattagaagcccatatggcgacgtggtctccttttccaatccccatccgcatgagacctttagcggtttgacggcacagactgtcaaattgagcgtacgtatagcggatatttcggtctggatacacaacagcatctcgatcgggatacgcatcagctgtttgttccagcagcctgccgattgtggaatggatgagttcagccattcattgttcctcctttcttaatgataggaaagcgtttacatttttattttaaaagctgtctggcgatcacgagacgctgaatttcagatgtgccttcaccgatttccattaattttgcgtcccgcagcatccgttccaccccatactctttcatatagcctgaacctccatggatttgaatggcttgattgcaagctcttgtcgccatttcagatgcgaatagcttggcgtacgccgcttctttggtgaacgggcggttatgatctttcagccaggcggcttttaacaccatttgccgtgccagatcaatttccatcgccatgtcagcaagcttaaattgaatcgcttgaaatgaagaaatcggctgtccaaactgctttcgttctttcgcatatgccaatgatgcgtcaagggccgcttgagcaatgccgactgcaagagcagcgatggagatgcgaccaccgtccagcgtatatagaaactgtttaaacccttttgttggatcgccgagtaagttggccgcaggcactcttacatcctcaagcaaaatttccgctgtattcgaaccgcggacgcccattttatcgtacgggctcgtaatcgtaagtcctggtgtgtcagttggcacgattaatgcggagatgatgttttttccatctttgtttttgcctgttactgcagtcacaataactgtgcgtgcgtagcttgcattagtgatccagcacttttcgccgttgattacatactcgtcaccatttgaaatcgcttttgtttgagtgcctcctgcatctgagcctgcatttggctccgtcaggccgaatgatccgagtgctgtgcctgaagccagcggcgtcaaatgcgtccgtttttgctcttctgttccgaagtagtatagagggcttgcgcctagcgagaccgctgcagcatagcttaatccagtactgccgcaggctttgccgacttcttcaaccgctaaggcatatgaaatcgtatcaccgccagatccgccgtattcttctggaaatggaatacccatcagaccgagttcacccatttttttaaatgtttgcatcgggaactcgcctgtttgatctacatgttcagcgtgaggagcaatttcttttttcgcaaaatcttttaccatttcacgcaccatttgttgttcttttgtcagctcaaaattcacatcgtttcctccttcacatctttgtaacatcctattaggcgagttctataatcattccctgacaagaaaagtctgaaaattaaaactgaatcattttttatgtgataatatcagcgggatgagcaaatacatgcagtaggcgcataccatccatatcgtaaacgcaataacttggccctttgataaagccgggaagatgaggggaagattccaaagggaaatcgtatccatcaataaaccgaccgctgatccccatatacctagcttgatcaccgcgaactgtgattgatcgagtttttgatagagaaagaacacaaggcataaaacaagagcagtgcccgctcccaagagaagaaagttcggcaaaaaggcttcttcagccggatcagtcaacacagcatctccgaacagcacaaaaaataatgtggcacctaaccagactagaaatgaaaacgtaaaacacgtcctgtacgtgtttctcttcgattttacttagtactagtttctcagattccaataatggaaaatgtccaaacaccgcctccatattcatgtgaatctcacctttgttttttaaaaaaatacagcggtttaccatcgtttcctgtctccaaaatcactaaaaaagacgacttagaaagccgtccttctcatttcttattttgttgttcgtttggaagctttgctttcgttatgaagccggtctgctgaagtgacataatacgtatatttcttgttgggatctgccgtgttatctaagaaggtttgctgctcatgtgtttttctttgcgttgccagcaatgttctctgctttttcccttcggctctgtatatcgcataataggctgtttctttcgttttttgatttgatgggtgatctttaatctgcagaagattgccgtttttgtcttcggtgactttcgtaagcttcggtttttttggggcggtattgtcaagccaaggcatttgcggaaccagtgccggcttgctgtaaaggtcggcgataagcctgtctttgatgccaagcggatttttgttgagatccttgaggctgaaatgcatgcttcctttcaccagttcaagctggcggttcaaagtgatttgccgcacatattcctcagggtcggaccaaggcggatcaaaattgttattgattttatatgctgcctggccaatatataagtgaacaggcctatttttgacttcattgctccaccaatcagccagcacgtcgtacgccgctgcgttaaagccgatactccaataaatttgcggagcaatataatcgatgtcgccttcttggatccaatgtcttgtgtctgcatatagatcgtcataatttctgacgcctgcttttgtattcgatccggtcgggtcatctgctgcgtttctccatactccaaagggactgatgccgaatttgacatacggttttgcagctttaattgtttggttgatttgtttgacaagctggttcacattgtcccgccgccagtcatcgatattagaaaaagcgtcttttccgtattgttcgtactgtgcttgatcaggaaattcctgtcctgctattttataagggtaaaaataatcatccatatgaacagcatcgatatcataatgttttacgacttcttcaatgcctttgacgataaaatctctcgcttctggaatgcctggatgataatacagctggtttccataggcggcaacccaatctggatgttttcttgccgggtgatcctcagacaatttattaagatctgtatgattcattgtaatacggtaaggattaaaccacgcgtgaaattccaaatttcgtttatgggtttcttcaatcataaatgcaagaggatcatagccggggtccttcccttggacaccggttaagtattccgaccaaggcccgtaagctgacggataaaaggcatcagccgtcggtttaatctgaacgataacggcattcattcccattttttgcacatcgtccagcagtttgatatactcctgtttttgctctttcacagataacccttttttggacggccaatcaatatttaatacggaagcaatccatacggctctcagctctctgtcagactgcgcattggccataaacggaacggaaatgacaaacgttccgatgatcaagctgacaaggaaacggataatcgacttttggcaaaccttcattctgtttcttctcccccattacatcactttcactcgctattacggtattcccgggctataaaagggtgattaacagaatgtctatctcactaaataaacgaaaaaagtcctaaagcatgttgtgggccgcttttaggactttttatcattcatcatggtttgcaaactttttaacacgtcaataagttttacgccgacaccgacagccgtttcaaggatcgcttgtgctccggcaatggctaaaataaagatcagcggtattgcaatacgaggcaaaaaaagatagccaagtccgatcaagatggcacaccaaacaccggcacaccagtagcaattgagcatgtatccaaagttagaagccggcacacttttttcatctacatgcccgttttgatcaacaatccttttctttttcataaaaggtttccggataaattctgtgattttgtcgaatacaatcaaatgtgtcagcctgtaactggctagaatcagcatgataaacgtaagaaaagatagatgatccatgacaagcctccaagaaaaaggatgatgttatcattccctagtgtcatcgatccattctttgatacaaaaagaagcggacagagaatgcctctgtccgcgaatccgctctattgtttgtgcgggattgctttatttgaagtgatcttttctaaaatgtcgaggatgatgtcagcattcttttcagcatatgttccttccagcatgtctttatgagcgccaaaacccgtgtactcactatagtttccacaggcgccttcccatttcgttaagcctgtattctcgctggtttctgggtggattccagcttcgatgaaatgaatacttgctttgatgtgcccttcattcagcaattgtgcccaatattcctgatagtttctttttttcttcatcaccttttctctgactgcttcaggcagatatgctgcagattcgtcattaccggtatcgataggcaaaggctgttcttttagataagcgtccacgataatgaagtcgctgacttctaatcctttgcgctccatagcctgtgccacttcaaaagccaggtttccgcctgcagagtagcctaataaaacgtatgggcccttaggctgtatgtccgtcatgcaattaacatattgttcaatgcgggtgtcttgttcaataaagtgaaacccgtatacggctgccttctcattcagcaataaagcaaggtctttaaaataaatgccaaatcccgatatcggcgggaagcagaaaagattttgcgcgccgtgctggttcagtttgatcacatgctgttcatttgctgctgtcagctgtttagaataaagtttttcggcaagctgagcgattgtcggatgttcgaacaagaaatcaatcggtatgtcaatgttctgctgatgttttagtgtatgtatgacttgcagtgcttttagtgaatgtccgccaatagcaaagaagtcatcatcaatactgattgtgttaacaccgaggacttgcttccaaatgttcgccaattcttcttcaaccaagtttcttggcaatatgatgttctgtcgtttggcaggcttattttctggaataggcagcgcgctgcggtctatttttccgtttccggtaagcggcatccgctccacacgcacccagtgctgcgggatcatatagtctggaagcacacgcgccaaatcggcgcgaaaatccgtatctgtttttttgtgatcaccgacgtaatgagtgtacagctgcgcctctccatctttttctctcaatgtcactgctgcttcttgaacgccttccatttctaacaggcgcgcttctatttcggcaggctcaattcgttttccgcggattttcatttgcctgtcaattctgctgatgtattctaagtttccatcaggcagccagcgcgccaaatcaccggtacggtatattctttctccaggcaagaaaggatgaggagaaaacacagcatttgtcaggtcatctttgttcaaatagcctttagcgaccccatcaccgccaacacaaagctcgccgggaacgcctattggcaaaagacgtccttttgtatctaagatgtaagcggtgctattgctgattggttttccaatcggaatcggccccgcatagtctctctttatttcaaaaaaggttgaaaaagtcgtgttttccgtaggcccgtaaatattatgaagcgcgagatctggacaggcgtgtctgacagcattcatcagagcaggagagagtgcttctcctccgacatataacgtatggaggccgcgaaacatgtcagctcgtacctgtgccagctgattaaaaagagctgtcgttaaaaatagcactgtgatgtcattttcaagcaaatacgctccaaaccgatcaggtgtcagcattgtcgatttatcaatgatatgaaggcttgcgccatttaaaagtgccccgaacatttcaaaggtgacggcgtcaaagctgatagatccagtcagaataaaccggtcatcaccggacgcagacgtgtaattgctgtttctgacaagggacacgacattgcgattcgtgatcatgacccctttcggccggcctgttgatcctgaggtatacatgatatatgcaagatcgtctggactggagatggtgttgataggaaaatggttctctcccatcaatgcctgcgcatctgcaatcatacatgttcctgagaacgcagcattttgctccagccccttttgaacaatcagcatttttgcttgcgtttcctcaagcataaagctgactcgttcaggcggaagctcctcatcaagcgggaggtatgctccccctgcttttaatacggcaagcacactgatcatgaattcgggagaatgtgcagccaatattccggctgtctcgtttttccgaaatcccttttgaattaactctctggcgagcgcattagagcgtttatcaagctctttatacgaaatagacatattgccatacacaagtgcggtatggtctggcgtcttttctgcttgttcgcgaaataaatcgataattgtatgtttctttggatactccgtttttgtattgttgaactgtgtgacaatctgctctttttctgttgcatcaagaaaagaaaaatcagcaattggcatatgagggtgctgtgcagctgtgctaagcgcttgcgtaaattgcctcttgatacaactgatccaggcagcatcgtaaacgaatgcattatagctgaacttgatgacaagctcttcgccgggagcaacgacaagattaaagttatatcctgattgctcggatacttgaacttgatcgatttgcagcggtgaatcggtctgatcagcggaatcggcgattttctgctgtaacggatagttttcaaagacgataatgtgatcaatcagttcctgttttaatgcggtgtttgcctgaatatcaaataaaggctggcaggtaaacggctcagcttccagcatttctttctggcatcgtatgaacagttcttgaaacgtttcgtcttgatgtgttttaattcgaatcggtatggtattgataaacaaccctatcatttgctccacgcccgggatttctgacggtcttcctgatacaactgcgccaaacacaacgtcgtctgtgcggttatattgctgcagcatcacaccccagacagcctgaataagggtagcgagcgtgacgccgtgttgtttggcagtctctttcagcttgtctgtcagtggtttatttaatgaaaatatcaaatcttcacggtgataaccttcttttgtttctttatcagacacacgaggcagaggtgatggagtgctgtagttttttaaataggtatcccagtaggccgctgctttttctttgtctcggtttgtcagccaggaaatataggtgctgtacggccggacagggtctaatgaaagcggttttcctgcatgaatcgattgataaatttgcataaattcctgcataacaatacctaggcaccatccgtccattaaaatgtgatggtgactccaaagacagacatgctcatcttcagctgttttgaacagagaaatccgcatcagcatgtctttttgcagatcaaagcctttttgcttgtccttctctttaaagcgttcaatatactcattctggtcgtttgttggcagatgggaaatgtcttcgctgtacaaatggaattcacgttctgtcatcacgacttgccgaggtcccgacaaatgcgggacgtgcggcaaaaacacggttctgaaaatatcatggcggtcgataatggcttgaatgctgcgctgaaaccatttatagctgaggcttcctttaatggtgaagagcgactgctcgacatacgccccctcctctttacggaggaaggaatgaaagagcattccctcctgcatgtgactcagaggataaatgttcttgattttttttatgttatccatagtgtctgcacctttcttcacggtttcattagtgaaaactgagcatatcagcaatctcttgcagggcatcctcggtcagttcttgatcatcataatcgctgatcgttttttctgtttcgcttttgttctggcagtgttcgatcagctgtaataaaaattgacggcatgtttcgctaagctgttcgatggttttgcgctgaaaacgggtagtgtcataagtcatattgacagtcattttcccttctgcagcgattgcactgatatccagcgactgttcacggttccatgttgtgctgatatcacccccggcacccagcggagagaatgagaaggcgtcctcctcaggtacttcagctgtgcggccgctttcaaattgaccaagataattaaagctgatttctggtgcacctgtgaaattgatgtcttttttgccaggcggagtcaaatatttgatgacaccgtagccgaatcctttgtcaggtacacgtctcagtgtatcttttgttgtttttagcacatgaaccatgtattcttccgaatctggcaagtctgcgttcaatttaaccaataacggataaatggcggtaaaccatccaaccgtccggctcacatctattccttctaatacatcctctcgcccgtggccctctaatgatagtttgaaggcggattgattggtccaatggcgcagcgcaagaatgacagaagcgagcagcatgtcctgcgtatcagtgttatatgcgctgttggcgtcttttaagagtgctgctgtctctttctcgtttaaggtaaacgaaatcgtggaccgttgtccctcgtgtgctctagttccatcaatgtgatcaaaaggcaatgcctctgtttgatactcttcggcttcgcgccaatacttgagctgtttcatgagctgctggctttcagcgtagtcagagagctttttcgtatacgctttaaatgagcttgttttaggcggcagtttgataaccttcccgtctgcagcttggcgataccctaaagccaaatcttcaagcagaacccgccatgaaatgccgtcaacgacgaggtgatgagcagataaaaataagaaatcaccgtcaattgtgtggaaaagaccggcttgcagcagcggaccattcttcaaatccattttctgctgaatatcaagtacatgacgtttgataataggctcatacgctctatttccatcagtgcataaatcaatcatctcaaggccgtacaacgcgtcgtccgaatgactgagcggccgattatattgatcccactttccttgttcattctgtgtaaacaccattcgcagcgcatcatgatgacacgttattgcttttaacgttttgcgcagtgcgtcttcttgtacaaaggtacttcgatgcagcattacggactgattaaaatggtgtttttcttttatatcttgagaaagaaaccatttttgaacaggcgaccattgtacgtctccctcaaccgcagcttggctggaacttgtatctgaatcacggatataagctgccaattcttgaatggtcggatggctaaacaaatctttcactgccatttgcttgcctatccggtgaagccgcgcagatacctgtaacgctttgattgaatctccgccaagttcaaagaacgaatcagctgttccgatcttttctgcccccagtacttcttgccatatatctgccagtatttgttccattttgctggctggcgggaggaatggacgttcaccttcgtggttatatacaggttttggaagtgctccgcgatccagcttgccgtttggtgacaatggaagtgagtccagtttttcaataaacgcagggtgcataaacaccggcagcttgttttgtaattctgagcgtacagcatttgtgctcaactctggttttgtcaccacataagcacttaattcggtttgtcctgacgctgtttcatgagcaactactgcggcgtcttttacaccatttatacaccggatgaccgattcaatttctttcgtttctacacggtatcctctgattttgacttgatcatcgattcttccgagatattcgagtgttccgtcggccatccatctggcggcgtctcctgttcggtacattcgtgtttcgggtttaaatggattctgcgtgaatgctctctctgtcagttctggaagattaacgtaccctcttgcaagccctgttcctgctatacaaagctctcccgcaacaccgattggctgaagctgatgattgctatttaaaatcagcacttgagtcccgtcaatcggctggccgatgcttacgtatgcctgcttttccatatgtctcatgacggtagtcgccacgctgttttctgtcggtccatattcgttggcgagttcggtatgcggacatatagctaagctgcggtcgatcaattcgcggtcagccgcttctcccgccagtgtgacgactctaagtgtctttacatcttccggctgcactatgtccaaaagcgctcgatataaaacaggcacaataatcatatgtgtaatccgttgacgagacagctgatgcttaatgaccagaatatccttcgcttcctcttcatgaagcaaaacggcttttgcacctgacaaaagcggtgtaaacatactcgttataaagccgtcaaatgagaaagaaaagagctgcagaatggtatctgtctcgttgaatgcataagcgtttcgccgccactgaagagtgttggcaatacctttatgctcgaccattaccccttttggacggcccgtcgttccagaggtataaatgatataagccaaatgatgagcagacgatacttgcggcagcggtgatttgtcgtatgcctctacactttctatcgctaagaactctccttcaaagtcagcaagtgcttcccgatccgcttcatttattgtcatcagcagtttcgttccgctgtcgctaaggatatagcgtttccgttctgtcgggtattcaggatcgatgggaacgtaacagcctccggctttccacacaccaagtatggatgctatcatactgaacgaacgatgcatcatgatgcctactggtgtgtccggcttaacacctcggctgcgcaatgcacgtgcgattccattggaccactcgtcaagctcctgataagtgagtgttttgtctccgctgacaagtgcagaagcttttggtgttcgtgcagcttgctgctcaaacaattgactgattgtttgaactccgtattgattcgcttgcccggtgttaaactcattaagcagctggtgccgctcttcttgggtcaggatgtcgatatggttgagtgtcacctccgggtttttgccgatgatgctaagtacatttgttaaatgcgatacccagcgttcaatggtggttttctcgaacaatgcggttgaatattcaaaaaggaaatgaatgtttccgtcgccctcagatgcctgtagtgtcaaatcgaatttagaaacgagatgagaaacttgtgccggcttcattttcaaatcatgaagatacaatggctcgtaatcattattttgaacaactaacatcgcatcaaacactgggttccggctcatatctcgtgtcaatccaagcttatcgacaagctcttcgaacgggtaatcttggtgctcaaaggcttccaatgctgtctcacgcacttcctgcaaatactgtacgaatggcttcccgccctccgggcgtgtccgaagcgccagcgtgttcacaaacatgccgagtatcggctcaagatccttgtgcggccggccggcgattggcgagccgacgatgatatcctcctgtccgcttaagcgtgacaagaacgcggtgtaagccgcaaggagcaccatgtacagtgtgcttccgttttctcgtgccagcttgtgaaggcctgatgcaacctcttgatccagcgtaaatgagaccttgtcaccagcgaagcttcgcaccggcgggcgggcatgatcagcggggagatccagcacaggcagctcgccctcgagctgcttcagccagtacgcctcttgcgttttgtacgcgtctcctgttttgaatccttcttgccatacggcataatctttatattgaatgcgcagcgccggaagcttccgattattgtacagctcgccgaattcttgaatcagaatgttgacggaaacaccgtctgaaatgatgtgatgcatatcaaccagcaacaggtgccgctcatctgatacctttacgatttgggcacggaacagcggcgcttggctgagatcaaacggtttgataaatgcggctgcggcctcctgttcggttcgttcgccgagaactgtagtctgtaacgtaaacggcacctcgtcatggatgcgctgcaccggatcgcctccttcgtcctgttcgaaggcggttcgaagcgactcgtggcgcttgatcagctcttggaaagctctgtccatcctttcagggttgagcttcccttcgagctctaacacagccggcatattgtagcctgtccctccgtcttccagctgctgaaggacataaatccgcttttgggcagaggaaaccggataggtttcctgtttttcagcgggcttaatcgcttcatatggactgtccgttccttcacggataacggtagccagtccttctaccgtcggatgggcaaacacatcttttagcggcacctgtacatcgaattctttggtgatccgtgagacaagcgccgttgcttttaaggaatgtcccccgcggtcaaaaaagttgtcgtgaatcccgacagggccatttttcagcacgtcctcccacagctgagaaagcttcatctcagtcacgtttctcggcgctgtgtaggtctccgcatctgccgctccgccaggagctggcagggcgtttcggtcgagctttccgcttggcgtaaccggccactgtttcatttctatcatataggctgggaccatgtagcccggcaacagtctctcaagctgtgcacgcacttcgtttctttggagcccttctatataagcgcataattccggctccccgctgtctgtccgtacggtaacagccgcctctcttacaccttctatatttcttagtgccgcttcaatttctcccggctcaatccggtagccgcggatttttacctgatcatccgtgcgcccgaggaattcaacattcccgtcagggagccagcgcgccacatccccggttttgtacatgcgttcccccgggtaaaacgggtcttcaagaaaacgctcctccgttaatgccggccgattcaaataacctctggcaacacccgctccggcaatgtatagttcaccgatacatccaacaggcagcatccgctgattctgattcaggatatacaatctgacatgatgaacaggttttccaattggaatccgttcaagtttttcttgcggcggacaatcaaagaatgcagcttctacggttgcttccgttggcccataggaattggttattgaaacatttggaagcaacacgtgaaatcgggagacaagatgggtctccagctgttctcccccagaaaacactcgcttgagtctgtttgtcttaatcggtacagagcgatattttatatgttctaaaaatgcatggagcattgaaggcacaaaatgcatagctgtgatcttttgttcttctatggccttcgcgatcacttcaggttctttttcgcctccctgaggaagcagataaacagaagctccggcataaggccagcaaaacagctcccatattgaagcatcgaatgaatatgatgttttgtgcataatcatatctgaatgctttagctgatagcgggactgtagggaattcaaaaaattcaccgctgatcgatgttcaatttcaacacccttaggcatcccggtagaaccggatgtatagatgacataggctaaagattgcgggagaacatccacattcggattggacaaacgatgtgccagtccgctatttgtctgattgagatagacaatctctcctgcaaatgccggaacatgaagaccggaagactgaagcaggagaatgtttgtaccgctgtccttcagcagaaagctgattcgttcttccggataatccgggtcaatgggcagataagcgccgccagctttaagaatgccataaatgccgatcagcatttcaggcgaacgccggcctataatggcaacagtcgtttcagattttactcctcgtccgatcagctcccaggcgatacggttagcctgttcgttcaattctttataggtcatcactccatcttcgaagataacggccgcctgatcaggcgtttttgctgcctgctgttcgagtgcatagtgtagcgtttgattcattgaatagcccgtctcctcaaacagatggcatgattcaatgaaatctctctcttcttcttttgttaagattggaatatcgtccaattctgtttcaggactggcagctgtatgttccacaagcgtggtgaaaaggctggcccacctttggatggtttctttctcaaacaaagctgtactgtattcaaactgacagaaaagctcggaatcatgctctgtaacgtatagggaaatatcaaattttgatattgggtgctccaagtcgttccactgaagctgtatatcattcatttttagcttttgctgttccatattctgaaggactagcgttgtgtcaaacaaaggattccggctcatttcccgctgcacaccgagtttgtccacaagctcttcaaacgggtaatcctgatgctcatacgcttctaatgccgtctgtctgacttctttcagaaattcctcaaatgtcttattacccgctgggcgtgtgcggagagccagtgtattgacgaacatcccaagaacagcttcaaggtcggcatggggccgtccggcgattggtgaaccaatcacgatatcatcctgaccgcttaaccgagacaaaaaggctgaatacaaagcgagaagcgtcatataaagcgtgcttctgtttttatgggcgagccgctttatgcgggccgtgatctctttgtccaattgaaaggttacttttccgcctatgaattgccgttctgccggacgtcgtttatctgttggaagctccagtataggaagatctccgctaaactgctgctgccagtaagtctcctgcttttggtacgagtctccctttttaaatttctgctgccatacggcgtaatctttatattggatccgcaatggcttaagctgccggtttgcataaagatcggtaaattctcggattaggagctgaacggatacgccatctgaaatgatatggtgcatatccaccagcaatacatgcttctcgtttgacacttctataaggcctgctctaaataatggcgcctggctgagatcaaagggacggacaaatccctcgatagtggtctctttacttaacgtaaacggcacttcggtgtggatacgctgaaccggctcgtcatcagctccaggtacaaaggaagttcgaagcggctcatgccgactgatcagttctttacatacagcagacagtttggcgacatccagtgcaccttccagttctaagaccgcaggcatgttataggcgacaccctcatcaagctgttgaagcacatagattcgtttttgggccgaagatacaggatatgtatcccttttttctgctggttcaattgctgcatacagattttgttctgcctctcgaataattaaagctaatccttcaacagtcggatgagcaaagatgtccttaagtgaaacttgcacatggaattcctttgcgatccgtgacataagcactgttgcttttaacgagtgaccgccattgtcaaaaaagttgtcttggatgcctatatgcccattctttagcacatcttcaaatagttgcgaaagctttgcctctaacagatttcgaggggcagtatatgggtttccgctgattgaagcatctggctccggaagtgctgcgcgatctacttttccgtttggggtaagaggtatgctgtcaacccatatccatttcgccggaatcatgtattctgggagctcactagccatataactgcgtaaatctattgcattcagcttttgtacactgcaatagtaagcgcataattcatgttcaccgttttgatcttgccagatgagaatggcagcctcactaatgtccggatgattcattagcgtgacttcgatttcttgcggctcaattcgataacctctgattttcacttgattgtctgcccgtccgatatattcgatgttgccgtcttcaagccgtctggccaaatcacctgtccggtacatgatcacatcaggcttgaatggatcggatgaaaatttgtcgcttgtcagtttatcgtgattgacatatcctctggcaacacttgcgccggaaatatagagttcgcctggtacgccgcatggctgaagctgtttttgatgattcaaaatatatagatcagtacagcctatcggtttaccgattggcggaagctcaggaatagggtctccaggatgaatggtatacgtagataccacatgagtttctgaaggtccgtaatgattgtgcaggtgtatgccgcgttcacacaacacatcttggaaaaggtctgaaatcattaattgttccccggctgcgatcaggtgtttgacgccatcaggaaacgagttcgcaagttctcgctcgctgaaaatcattttgataaaagcagttgggagaaacacaatattcgtctgatgcttgtttataaatgcaaacagctgaggcacatctctttttatggcttctggcacgatgtggagtgtgccgcctttcagaagcgcagaaaatatttcttgatagcagacgtcgaaggaaggtgtcgcaaattgcagaacatctgcttcaaagtcaatgccggagtgagtatattcgaacttcagcaagttagccatgtttcgatgctcaaattgaacaccctttggtttacctgttgtgcctgatgtataaatcatatacagcagatcgtcagcattgttgactgactttatgttactgccgtctactttgctttcgatatcttctggatgagtgataatgtaattgtcttctaacgatgaggaaagatgcgcttgtgaaacaacatgcgaacagccgcaatcatgcagaatataacggattctgtcagccgggtaatgcggatcaaccggaacaatggcgccgcctgctttcaagataccaagaacacctgtgataaacgccgctgagcgttccatcataatcgcaacgggttcctgtctcacaacgcctttcattcgtaaatgccgtgccaatctgttagccgctttattcagttctctgtatgttaatgagcaggcttgatcaattacagcatgagcatctggtgtcttttccgcttgcttttcaaacatggcatggatggtttcgtaaactggtgttcgatctgtgatttctccaatcagctgccgcttttcagtatctgtcgtgatatcgatttcttcaggtggaagattcggattatttaagatttgtgatacagcattcagaagatgctctttgacagagagcacaaaagaccgatcgtgctgctccgcatcatagttcattttgatatgaatttcttcccctggcgccaccataagataaaagctgtagttggtttcatctgcgacagtgaaattatgaatctgaaaaagatcagaagcatgttcctgtttgttcagcatttgaatctcttgctgcaccggatagttttcaaatacgagaatatgatcaatcagcccttgtttaacagctgagcgggattgaatctcatataaagggtggtagctgtacgcttcagcggcaagacggtctttttgcatatcttttataagttgaagaaatggcgtttttgccccctgcacccgaaccggcatcgtattaatgaaaagacctaccatatgttcaatgccttcgatttctgcgggtcttcctgaaatgacagaaccgaatacggcgtcatcgttattattatatttttgtagcagaatgccccaaatggtatgaaaaatcgtactgagtgtcacttcttctcttgcagcaagctctgaaagtctgctgctttcttccttagagaatgaaaatgtaacgtgttcctgcctgctttttccctttgtttttttctgcttcgggagcacggtttgctgttcgtggccggaaagataatggtcccaataagaaaccgcctgctctttgtcttgctccatcagccatttgatatactttccgtatggctggaccggctccaatgttataggggatgcatttacataagatgcgtaaatatgcagaaactcctttagcacaatgctgaggcaccaaccgtccatcatgatatgatgaaaggtccaaatgcaagagtactggctctctcctgtttgaataagagcgatgcgcatgagcacatccttttgcaaatgaaacccccggtcccggtccttttctttccattgctcgataaactgtgattgctccgcctcgtttaaatgagtaatgtcttcttccagcacgatgacatttcgttctctcagaacaacctgctggggggaggaaacattttggctgataaaaatcgttctgaaaatatcatgtctttctacaagagcgttgatgctgttttgaaaaaactgcgggttgacttttccttctattgtaaaagaagcttgctcaacatacgcctgtgaatctttttgcaggagggaatggaaaagcatcccttcctgcatgtaagacagcggataaatatcctgaattgaattcgcttttgtcatgttcatgtctccctgtcacgattttctacaattcttccaccaagctggatatgctgtccaagtcctctgccgttaatgattgactgctgaaatcgctcagtgtcttttctgctttctgttgaccggcgcagtgtttcataatgtccagcaaaaagtgttcaatcctgttaataagctgctccattgtgtttctgtgaaagcgggctggcggataactaagattgaaatggagctttttgtctgctgccattgcactcatctcgatgatttgctcacgcttccatgtatgagtgatatcctttccgctaccaaggcttgatgggcggaaggtgtcctgtctttcgatgtcgttgaactggcccaaatagttaaagctgatttcaggtgtttttgaaaacgtaatgcttttattttcagggtgtgtaaggtatttcagcataccgtaacctacccctttgtttggtatccggcccagtgtatctttaacggtttttactgaggttccgagctcatccctatgattttcaaagcttatgagggccgggtacatggatgtaaaccagcctaccgtcctgctgatatctaactctggcagaatgtgttctctcccgtgtccttccatagcgatacggagcttgcttcctcctgtccattcacaaatcgccaaggatgctgcggttaacagaatatcttgtgtatctgtgccataggcgtgattgacgttttgcagcaagacggcggtgtctgcttcagtcagtgaaaagcttaatgagtcccttttgctggtgtccatgttcagatgctgcggtatttcgtatggcagttctgcggcttgctgttcttctatacttcgccaatacgcctcttcgcgaatcagcttactgctttgggcatattcctgtatgcgtcttgcgtattcctggtaggaatccgttttaggcggaagctggatcgtctggcctgcagcagcttgttgatatccggctgacaaatcctcaagcaaaatccgccatgagacaccatcaacgacaaggtgatggatcgcaaggaacaagtaatctccgatcagtgttttaaacaaagcggcgtgcaacaatggtccttcctgcaaattgatgctttgctgaagatctgcaacttcttgtttgatttgcgtctcccagccgctttctgactgtgaaagatcagaggttcttaagctgtatagctgtgactcatgaatgccttggttgatttgaatccatcgcctatcatcgttgcgataaaccatccgaagcgcatcatgatgctccgccagttttttcaaggctggtctaagggcgttttcagacaaacgtccagaatggaatagcatgacagactgattgaaatggtgtctttcttcaatatcttgtgaaaaaaaccattgctgaacaggcgtccaaggaacgtctccctgaatgggtccttgctctatgattctctctgacttacggataaatggtgataagtcctttatctttggatgacggaataaatcacttacctgcaagcttagcccatagcgcccaaggcgtgcagaaacttgaagcgctttgattgaatctccgcccaattcaaaaaacgaatcctctattccgatcctctggatgccgagaacctcctgccagatcaacacaagttggtcttcaaggtcatttcgaggcggagcgtacgtttgtttagatgtgaaatttggttcaggaagtgcttttcggttcaatttgccgtttgatgtgagcggaagagtctccatttcaataatgtacgccgggatcatatagtttggcagcgaacgcgcgagaagtgaacgcacttgttcagcattcgtgcctgcttttacgctgatatagccaaacagctctttgctcccggtctgggctgtacgtgctaacactgcggcttctttgaccccgtctatttgacgaagtgctgattcgatctcacccagctccacacgatagcctctgacttttacttgatcatcaatacggccaacgtactcaattgtgccgtcaggaagccagcgcgccagatcacctgtgcgatacagtcgatcgccaggtgcaaatggatgtgggacaaatttctctttcgttaaatcaggacggcccaaatatcctctggcgacgccatctccgccgacacaaagttcaccgacagctccgaccggctgcagcactccccattgatttaagatataagcggtggaattaccaaccggccgcccgatcggaatggaaagttcatatgttttttgaatgtgaaggcatgtcgaaaaagttgtattttcggtagggccatatccattccatatagatacttcagggcagacatttctgattcgattgacgtggctcggcgacaaagcttctccgccaataatcaaatgtttcagctgtgaaaatgtttgttcattttgttctgtcaaatgattgaatagagaagatgtcagccaaatcgttgtgattccttgatgttctatgtacctcttaagctgatgggaatcgagaaatgtttgttgatcggacagatgcaaagcggcaccatttagcagcggtccgaaaatttcaaatgacccaacgtcgaaacctattgatgatgtcatcagaaggcggtcttcaggtgtaaatgtaatataattgctgtttttaacaagacgaattacacttcgctgctcaatcatgacaccctttggtttaccggttgatccagaggtataaatgatatatgcgagtgaatgtggccctgctgaagaatcaacgttcttcgtttttccttgcttttgaatatcttcgattatgatttgttcacattcaatgtctaatagctgtttttctgttttttcagattgaaggagtaatgccgccccgctgtctgacagcatataagctattcgttcaacaggcagatcagaagcaataggcagataggctcccccggctttcagaatgcctagcattcctgcaatgagttctggtgttctgcctgtcaacaaggctacaacactatcaggccctacgcccttaatctgtagaactgaggcaatttgatttgcccagctgttcaggtcctcgtaagtaaatacttgggtgtcgctgacaattgctacagcattaggcgtttgttcagcctgcatttcaaagagtctgctgatggtttcatttcttggataatctatttttgtgcgattgagctcgtggataaggtaatgggtctcatcctcattcaggatatttattgttccgagagcggctttgttgtctttgaagatggagagtaacatattgatgaagtattgaagccacttttctatcgtttttttcttatataagtcagtactaaactccatttggaacgtcagcaaaccgtggggctgttcctgggcatatagggttaaatcaaatttggacgtttgatgcccattgtttgctgcaggtttgagacaaagttcatccagctccaacgattcctgatccatgttttgaagaacaaacattacgtcaaacagcggatttctgctcatatcccgtgtcaattcaagcttatcaacaagctcttcgaacgggtaatcttggtgctcaaaggcttccaatgctgtctcacgcacttcctgcaaatactgtacgaatggcttcccgccctccgggcgtgtccgaagcgccagcgtgttcacaaacattccgagtatcggctcaagatccttgtgcggccggccggcaattggcgagccgacgatgatatcttcctgtccgcttaagcgtgacaagaacgcggtgtaagccgcaaggagcaccatgtacagtgtgcttccgttttctcgtgccagcttgtgaaggcctgatgcaacctcttgatccagcgtaaatgagaccttgtcacccgcgaagcttcgcaccggcgggcgggcatgatcagccggaagatccagcacaggcagctcgccctcgagctgcttcagccagtacgcctcttgcgttttgtacgcgtctcctgttttgaatccttcttgccatacggcataatctttatattgaatgcgcagtgccggaagattccgattattgtacagctcgccgaattcccgaatcagaatgttgacggaaacaccgtctgaaatgatgtgatgcatatcaaccagcaacaggtgccgctcatctgatatctttacgatttgggcacggaacagcggcgcttggctgagatcaaacggtttgataaatgcggctgcggcctcctgttcggttcgttcgccgagaactgtagtctgtaacgtaaacggcacctcgtcatggatgcgctgcaccggatcgcctcctgcgtcctgttcgaaggaggtacgaagcgactcgtggcgcttgatcagctctttgaaagctctgtccatcctttcaggggtgagcttcccttcgagctctaacacagccggcatattgtagcctgtccctctgtcctccagctgctgaaggacataaatccgcttttgggcagaggaaaccggataggtttcctgtttttcagcgggcttaatcgcttcatatggactgtccgttccttcacggataacggtagccagtccttctactgtcggatgggcaaacacatcttttagcggcacctgtacatcgaattctttggcgatccgtgagacaagcgccgttgcttttaaggaatggcccccgcggtcaaaaaagttgtcgtgaatcccgacagggccatttttcagcacgtcctcccacagctgagaaagcttcatctcagtcacgtttctcggcgctgtgtaggtctccgcatctgccgctccgtcaggagctggcagggcgtttcggtcgagctttccgcttggcgtaacaggccactgttccatttctatcatataggctgggaccatgtagcccggcaacaggctctcaagctgcgctcggacttcgtttctttggagcccttctacataagcgcataattccggctcgccgctgtctgtccgtacggtaacggccgcctcccttacgccttctatgcttcttagtgccgcttcaatctctcccggctcaatccggtagccgcggattttcacctgatcatccgtgcgcccgaggaattcaacattcccgtcagggagccagcgcgccacgtctcctgttttgtacatgcgttcccccgggtaaaacgggtcctcaagaaaacgctcctccgttaatgccggccgattcaaataacctctggcaacacccgctccggcaatgtatagttcgccggcgacaccggaaggctgtacggctaaatgcggatctaaaacatacaaacgcgcaccaggtacgggcttcccaatcggaatccgcaaacggtctctgtcccgttctggatccaatacgtaaaatgccgcgtctaccgttgcttctgtcggcccgtagccatggattaatgatacctgcggcaatacagaagcaaaacgggctgccgtacgcggcgcaagcggttcacctccggcgaatacacgctttaggtttgtcccgtcaccaagcgctaacatttctgcttgatccagaaagctattcagcatagccggaataaaatgagccgttgtcactttttcctgatgaatggcttttacgatcaatgcggagtctttttcccagccgggcggaagcagatacgccgaagcaccggaaagagcccaccaaaacagctgccacacagacgcatcaaaggaaaaagaggttttcaccatgacaatgtcatcttctgaaagcggaaactggtgctgcatgccggtcagaaaggaaacagcctggcggtgctcaacggccactcctttcggctgcccggtagaccccgatgtatagatgacataggcgagagaaccgccgtcagcaggagtaaacagatggttttctgctttttcgctcgcaagagatgtcatatccacttcaagcgtttcgccagaaaagttcggtgcggagcatcccggctgtgtcagcaagagcgatgccccgctgtctttcagcatgtagctcagccgctcctccggatacgcaggatcaagcggcaaatacgccccgccggccttcagtacagcaaggacagcgatcagcatgtcaggtgagcgttcagacaggatcccgacgatactttcgtttgtgacgccgcgtgccgcaaggtgagcagccagccggctggcgtacatatcaagctcagcgtatgtcagcgaaccgcctgaaaagcgaatcgctggccgctccggtgtgactgccgcctgtcgttcaaacagcccatgcaaggttggggcttcaggtgaaacagatactgtcctgttattttgagaaacgattttccgtgttttgtcctcatctagcaatgtcatctttgacacaggaagagatggatcagagatgacgtcagagatcatgtgctgtaaataatcttttatttcggacatcatatttggttgataagtgcctgtatgaaaatgaatccgaacgtacaaagtacgccctgggatcactttgacactgcatctataattagttacctcttccatctcaaaatctttcacggagaaatcaaatgatccagcttgattcagctcttcaatctcttgttgagtaggtgtattttcaaagacgataatatgatcaatcagctcttgtttaagagcgctctgcgcctgaatgtcatataaagggaagtaactatacgcttctgcttcagtcatgtccttttgcattccgctgactaggtcagaaaaagacagaaaatcactttggactcgaataggaatggtattgataaaaagtccgaccatgttttccacatcttttagctcagaaggtctgcctgatataactgatccgaatacagcatcgtcgcgacgattgaacttttggagcatgattccccataaagcttggaaaacagtgttaagtgtcgcaccacatgctgcagcgattttctgtaattcggaggtttctttttcaggaatggtaaacgtgatctgctgtaatgtcccatccgacatttgatctgttcttttaggcagaggtgaagctttttcgaaatgctgaagcctctttttccaatactcagctgcttcttcccggtcttgctgcatcagccatttaatatacgtcccgtacggctgtacgggaggcaaatcaggaaactgcccttttccaagcgcttgataaatatggagaaagtctttaatgacgatgcctaaacaccagccatccattaaaatatgatggtggctccagatacagacataatgatcaggcgcccattttaaaatagatattctcatcagtacatccgtttggagatcaaagccttttgatttatcctgttctttgaatgcctctgtacaatgttctttatctttttcattgagatgagaaatatcttcaacatgaatatggcaatgacgttgcttgagcacgacttgacgaggtttggctacatttttatagatgaatgctgttcgaaagatatcgtacctgtcaaaaacagcatccatacttttctggaaacgctccaagtcgagctgtccattgatcgtaaaagaagcctgttcaaaataagctctcgactgttcatcatacaatgagtgaaaaagcatcccttcctgcataaatgacaaagggtatatatcctgtatttcaggttgctgcggcatcagtgaatctcctctcctatagtttgttgacggctcccatgatctcactcaattcatcaagcgttaagtcttcatcagtgaaatcagatgcgctccactctcggttttctttgccggtacaatgctcaatgatgttttccagagtctgtttaaaatgcctggaaaatgtttggattgttttttcctcaaattgaaccctgttatagatgatgtgcatgttcaggcaccccgaagaaacggcgccgctgatatccagtgcataaggacgctcccagttcgggctgatctcatttcctggcttgatgtcagacacctcaaaggcatttgattgaatatcctgatcaaactggcctaaataattaaagctgatttctgggctgtttttctgagagccccatcttttgctgatatatttcagcacgccgtagcccgcgcctttatgcggtatacggtgcagcatatcttttgtctgtttaataaggtggcccagccgctcttctttgtccttatgatcggaatctctcatatcaagccacacaggataaatggaggtgaaccagccaacagttctgctaatatcgatgtcctcaagatatgattcccttccatggccctccatgctgattttaaattggttatttcccgtccatttctgcaaagcaaaacctaaagctgtcagaaggatatcattcatctccgtgctgtaagctttatgtgcagccgttaatagtaattctgtgtgatggcgagatagctcaaaatcaatcacttctgtatctatgaatgtgttagatgctgcgtcattgtcttttggaataggctggatgtgacggttctcgcactcatcccagtacgctgcttctcgctgcacctggcggcttttagagtagtcagctattctttgtgaatacgttaaatatgaatctgtttttttcggcaatttaatagattctcctgagactgcctgtttgtaagcagctgaaaaatcctcgaacaaaatgcgccaggaaaccgcatcaacaactaagtgatgaatcgtcagaaataaatggtcaccattctcggttctaaacaatccagcatgaagcaaggggccggtttccaaacgaatatgttcttgcatccggctggctgcttcctcaatcgtgtaccgtgcttctgttaggctatcctttacatcaaacagttcaagtgcatatagctcctcatctgaaagatctatccctctgtttatctgcacctgcctgccatcttcatgccggcatacgattctcagtgcatcatgatgagtcacaaggctttttagtacttttctaagcgcagcctcatcaaatcgttcagcccggtagatcataacggactggttaaaatgatggctttccagagattgcgagaaaaaccactgctggataggtgtccaagtaatctcgccttcgaccgggccttggtcaatggcgcgtacgtcttttcgaacccgggcggacagttcaccaagagtctgatgttcaaacatctcacgtactgtcgtttcaaatccgcgctgcttcagtctggcacaaacctgcagcgctttaatagagtctccgccaagctcaaagaaattggcgcttacacccagctcatctacattaagaagctcctcccaaatttcagccatgaccgtttcaatctcatttctaggactgatatcatcagatgtataagcgtgtttttcaggctcaggcagggctttctgatcgagctttccattaacagtcaccgggatgctgtcaatttgtatcatacgggcaggcagcataaagtcaggcaaggcgttttttaggtaagcccggatgtctgatatattcgcagcctgttgatcttttatcaccatgtaagcatatatagctgtttgcccttgctcgtctgctctggtaatgacagccgcctctttaatcattggatactgaagaagtgccgcttggatttcgcctaactcaatacggtgccctctgactttcacctgctcatcaatgcggcctaagtattccagctcgccatttgacaggcgcttagcaagatctcctgttcggtataatctgtctcccggaagataaggattggatacaaaacggtcagcggtcagctcatctctgttgagatatccccgtgccacaccttcgccgcctatatacagctcccctggaactccgatcggctgaagattcatatgagcatccatcacataagcctgcagagttgaaagcggccgtccgatattgcttttattttttacaatgtctgctgcggacaattttttgaatgttacatggaccgttgtttctgtaataccgtacatattaatcaaatcagtatgaggatattttttattccagctttgaagcatgccgggctgtaaggcttcgccgccaaaaatcacgtagcggatgtttaaatgatctgtatgattttgatcttcaagcatcaagctgtaaaaagcagtcggggtctgattgagtacagtgacgcgctctttttttaacaataaacggaatgcatgggggtcacgggctgtttctttagagaccacgactaatgtacctccgttcaataacgcaccgaacatctcccatacagagaaatcaaagcaataagaatgaaataacgtccagatgtcttcatggttaaattcaaaaggcaggttttgatgcttcaagagactgatcacattgcggtgctcgacaatgactccctttggctggccagtcgttccagatgtgtatatcacgtatgcgggctgatctgttactatttcttgaatgtttgcatcagccggaattgagttgttttcacattcatcgatatacaaaatatgcccggtgtagtctgcaggtttgttttgaccgcgctctgtcagcagcagttttgctccgctgtcattaagcataaagctaatacgctccttgggatattcaggatcaatcggcaaataggccccgccagcttttaaaatcgataaaacgccaatgatcatatcaggtgaccgatcgagcatcagaccgacgatatcgccagttcttaccccttgtttgatcagcatagcagctgcccgctcggctttttcattcaggtctcgatacgtaagctgagaatggccgcacaccactgcgatatgctccggatatttagcggcttgcttttcaaataagcttactatgttttcatttctcggataagccgcatactgtcccattttttcaaggagcaacctacgctctgcagcaggaagcaattgcatgtccgaaattctcatctcggtatccgccgttacccctttcaccaattcaataaaataggatgcccactgcgtaatggtttcttcttcaaaaagagcagtgctgtattcaaaacggcagcgtatcccactaggatgctcctcagcgtgtaatgttaaatcgaatttagatatatcatgtttaggagtgacagacgaaatcgacagaccaggcacttcgaaccggaaatcttcactgctttgaagcacaagcatcgcatcgaacagcgggttgcgatttacctctcgatttgtatcgagcttatctgccagctcctcaaaaggataatcctgatgctcgtaagcggtcagagccaggtggcgaatgtcctgcaaataggagctgaacgttttgtggccctcgggcttgctgcgcatcgccaatgtattgacgaacatcccaatgacgcgctccagatcagcgtgcggtcttccggcagcaggcgaaccgacaacaatatcctcttgtccgcttagcttagataacaaaatagaatagacagccagaagaatcatatataatgttgttcccgtttcagccattaaacggtgcagctcatcagccatgtctttatcaatgttgacttcaattgttccaccgctgaaatcagggagacgcggccttgttttatcaagcggtaattctagtgtaggaagactcccgccaagctgaccgagccagtaggcctcctgttttttgtatagctcttttgggtgcttctcttgctgccaaacagcaaaatccttataatgcaggtttaaagctggcaactcttttccgcgatataagtcagtaaattcttggacaagagtgctcatcgagacaccgtcggcaataatatggtgcatatcgagcagcaaaaagccgcggtgattgccgattgtaatgacacatgctctaaaaagcggaccggatgatagatcaaacggtttgataaaggtctcgattgcagactcaagcatttgttctgattccatttcaagctcttttagatcaaaagctatctctggataaatgatctgcacaggctcgtctctgtcaagcacaaaaacagtccgtaatgcttcatgccgattcacaagttctgtgagaacgcttctcaaccgctggcggttcagatttccgcgtaattcaagtacagctggcatgttataacctgtgctggcatctgccagctgatgaagagcatataatcgtttttgcgagaaagacagcggatagacatctctttgatccgcaggttcaatctgtgtaaaagcgtgttcttttaagctcatcaatttgaccgccatgctttcaaccgtcggatatgaaaacacctcactgagcggcagctcgacattaagctttttatgtattcttgataccagtgcggccgcttttaaggactgtccgcctaactgaaagaaatcatcacgaatgccgatgtgctgtttattcagcacatcttcccaaatatgtgcgagatcagcttcgattaaggttcggggcgccatatatgtgacactcgtattgttttctggttcaggaagcgcaaacctgtcaagcttgccgctggatgttaatggcatccggctgatgttgataatacttgctgggatcatataggacggcaatgtcccggcaagatgctgatacaaatctgggaggctgtttcccttttccggaacgatataagcaacgagctccttttcctcagcagaaacatcacgggccagtaccgctgcttcttttacccccggtgcttgtcgaagaactgtttcaatctctctcagttcaatacgataacccctaattttcacttgatcatcaaaacgtccaatatattcaatcgttccatcaggcaaaaagcggcctgcatcacctgttcggtataaacgctccccttcaaggaatggatgatcggagaatgctttctgtgtcagctcttgctgtttgtagtatcctctcgcaagacccgcgccggaaatacacagttcacccgccgcgccgatcggctgcatttgatttccgtgcaaaacaaatacttttgtgtttctgatcgggtgtccgattgtgatcctctctttttcattcagatgccgcaatattgttgttgccacactgttttctgtgggcccgtattcatttgccagttctgcagaaggacaaatcatttgactcaactcaagcagatcaggcgtgaccgcttcacccgcaaatgtcacaatacgaagactttttgcatcgtcagcagtcatcacttccaataacaccctgtacagggaaggaacaatgatcatgtggctgaccttataacgggctatttttcgcttaagggccagcacatccttcgcttcgtcatctgttgtcagcagtacgcacgcaccggataaaagcggggtaaataagctcgttacacagccgtcaaacacgtacgaaaacaaatggagggatatatcctgttcggtcatgtcatactcttcccgtctccattgcaatgtattggcaataccgtgatgatctactaaaacccctttagggcgccccgtcgttcccgacgtatagatcaagtaggctagatcacctggcggcatatttggagcttctgtttggtaactttctgtatgttctatcgttatcgtatttccttcataggacggagggatcaaggaaataaggtcttcttctatcagcaattgagccgcttgactgtccttcagcaggaaagaaagacgttctgctggaaaatgtggatcaagcggcatataagcgccgcctgctttccaaatcccaagcagagctgcaggcatttccattgaccggcccatcatcacagccacgatatctccagatctaacgcctttttctatcagggcgtgcgcaatctgattggctcttatatttaattggcgataggtccagcaatcgtctcccatttttaatgcagccgcttcaggtgttttgcgggcttgttcctcgaacaattggggtatcgttttgttcacataaggacgctcagtttcgttaaacgattggataacctgttgctcctccggcggcacgatattgatgtcactgacggcaacatcgggatttgtcaaaatgcaatccagtgcttgctttagatgcccctgaatcctcagcatctcctcccgctcgtaaacgtctgcgttgtagctgaatttgatataaaatgattctcccggaacgataacgatattaaagtcgtaattggtttgttccgacattgaaatgtcactcagcttcagagcgccttcgtcattttcactctccacgcttaatgcctgatgaagctgtacagggtaattttcaaaaacaaaaatatgatcgatcaacccttgcttcaatggactatggttttgaatttcataaagcggataatacccatgctgttcagatgataaaatatcctcctgcacggctttgaccagcgaagaaaacgttatgccttccgcagatcggattcgcactggaacagtattgataaacaagccgaccattgattcaatcccgtcaatcgctgacgggcgtcccgaaatgacggagccaaaaacggcatcggcatcatctgcagcattatatcgatggagcagcacgccccaaatactcataaacaacgtgtttaatgtcactccccagttttgggcagcctctgtcagtttctcaaccatttcctgcgctaatgaaaagctgacctggtcggctttataattcccgtctgccgtgcggcgctttattcggggaatagaagcagtattgccgtactccttcaaatattcgctccagtaggcagcggtctcttcttgatcttgttctccgagccattcaatataacggctgtacggcaccgtgctgccaagctgtacaggtgagttatttttgagcgaatcatacatgctgaaaaactctttaagaataatgccgagacaccacccatccatgatgatatggtgatgtgtccagacacatgtatattggctgtctcctctatcaaaaagggcaagacgcattaaaggatctttttgcaaatcaaatcctttttcccgatccttagtcataaaagcatcaatcagcgtctgctgttcttgatcagccaggcgagaaatatcttctctatatactgtcaattcccggtttgataagactacctgctgcggacctgtaagatctggtacttctttaatgaaaatcgttctgaaaatatcatatctagaaacaagaaggtttaagctcttttgaaacgagtcgacgcatagattccctgtgatcgtaaacgaggtctgttcgatatatgctttcgagctgaaatccattaatgaatgaaacagcattccttcctgcatgtgcgataacggataaatatcttgaatttgtgccgattgtgccatcaattccacacaccttttcaaaagttaaagatctttcacgagatcttcgatgctagataatgcagacaacgttaattccttattgctgaaatcgctcaatgttttttcgcgtgcttttttctgcgaacaatgctcaatcgtctcgataagatgcctgtgaaaacgatccataaaacactcaattgagtgtttgctgaacacctgggtgtataccgcttttacttgaagccgtccgtccgtaatgagagcgttaatgtccagctcatactctcgttctctctcacccgctatttcgtaacggggctggtaatatgataattgaaacgtatcagcttctttctcttcgctaaattgaccgagataattaaagctgacctcaggctctttatgccgcagttctcctatgtgtgttaacaatccgtatccagttcctttgttcggtactcttctcagcatatcttttgtcatcttaattcggtatgcgagctgatcctcgaaaggctcgggaatacccatgtctagcagaataggataaatggaagtaaaccatccaactgtccttgaaatatcaatgtttggcacatgcccttctctaccgtgtccctcagtgctgatcacgatttggtcatgcccagtccattcagaaagcgccaatcctaaagccgtaagcaaaagttcgttggcatcagtaccataggcttgctgggtttcaaacagcaatttttcagtccagtctccggatagtacaaacgcggctgcgtcgctattcatttggagtctgtccggcacattttctatgtccttaggaagaaaagcagtgtgagcgtctaaaatcgtttgccaatacgttttctctgaaagcaattgtttactttcagctatttgggtaagaccatcggcgtaggataaataagaatccgtttttggcggtaattggatttctttcttttctaaagcctgttgatatgctgcagctaaatcttcaagcagaattctccaagaaacgccatctatcacaagatgatgaagtgcaatcagcaaatgatccccttctgccgttttaaacaaacctgcttgcagcaaaggccctttttctacattcattttgctttgaatgacggtttcctcagcggcaagtttttcatcaagatgagccctttccagcgatgcttttgtccaatctgaaatataaaggccaaacagttcatgatccttgtgattgattccgcgattaaactgaatgacatggccgttttggtcacgttggaaaatcatgcgaatggcatcatgatgctcgattattttacgcagcgctagatgaagcgcgttagcattgaatcctttttcactgaaaagcatgacggactggttgtaatgatagtgaaaagcatgtacctgtccgaaaaatcttcgctgaatcggggtgagttcagcttcaccttccgcaggtccctggtccgcttgagatgccaatggtgtgatatgtccgcatagttcctgaatcgttgaataacggaataagtcgcgtattgtcatgctccagccttcagctgccagacgtgctgccacttgtaatgctttaattgagtctccgccaagctcaaaaaaggaatcgtgaatgccgactcgtgacatgctcagtacatcttcccatatatacgccatcgttttttgtatgtcgttaactggtgcggtatatggacgcgataacacattatttggagccggcaaggcatttctgtccagctttccgtttagggtcagcggcatgttttctaaaggaatcagatgtgcaggaatcatatacgctggcagctcctttgttaaagcagcacggagagcattcgtattgacgtctgaaggcacaatatatgctgccaaaccagcctgtccatttttatcatgctgaacggcaacagcagcttctctgacaagccccgtttgaagcagaacactttcaatttcttctgtttcaattctgtatccatttatctttacttgataatccattcggccaagaagcctgatcgttccgtttggaagccagcatgctcgatcaccggttctgtacagcctttctccagagacaaatggattttctgtaaatttcatttgcgttaagtcaggtttatgatgatagcctttcgcaacacctgccccgccgatgcacagctcgccggcaacaccgatcggctgaatttgatcagtctggctgagtacgtacatgtgtacattcggcagcgggctgccgattggtacgttatctcccgtacactctccacccatactggtttcatagaaactcgaatcaatggttgcctctgtgacaccatagctattaatgatgcgcatgctttggccaaagcgatctgtcaatgttttgaaatcttgagctttcaccatgtcggaaccaaggatcagcatgtctaagtcaggaagcttgaactggttacggtatacatactccatcaccgggataatgagagccggtgtcgactccatcaccgtgattctctgagagttcatgattttatatatttcagcaggttccagccgtgtttcatctgggcaaacgattagagtcccgccgttggtcaatgttctcgccaaatctcctgagaagacatcgaatgaaaagctcgcgatttgaagcagtctgacaggcttccgatccagttcataaatttgacgccaagcaagagcagcatgagtaaagttctgataggtgacaataacacctttaggcgcacccgtcgttcctgacgtataaatgatatataccggctcttcaggagcaggagataagttaaggttgcagttactttcttcataagtgctttcatcgtcaaggcagatatgagacatctcagattcaggcaagtttgaaatcaaatgcttcaattcctgctgtgaaagtagaatatctgccccgctatcacgaagaatatattcaatacgggcttttggataatgtgaatcgattgggatatacactccgccagctttcatcactgccagcactccaacaattgcatcaatggaccgcttggctaaaacagccacagttggcttcggtccttttctgttttgcaatgttcgtgccagacgattggctctttcatttagaagccgatagctaatctctgtttcgttatcaataacagctatatgttctggaatttcttcagctttcgcttcaaatatgcgatgaaaaggaacatctttttgagcaaattcaacctgagttttgttaaattcaaagactattttttgtttttctttatcactaagtatgtttatttgtgcaaggcttgtttcaggggttgaaagtgccgcatgcagaaattggataaaatgatcagcccaccgttcaatcgtagcttttaggaatacttctgtactaaattccatttcgcagcaaatagatccacttacttccgtagctattaatgtgatatcaaataaagaaatgtaatgtgcgaaattggcaggccggacttttatttctctcagatctatgtcctgtttttccacattttgaaggataaacatcgcatcaaacactgggttccggctcatatctcgtgtcaattcaagcttatcaacaagctgttcgaacgggtaatcctgatgctcaaaggcttccaatgctgtctcacgcacttcctgcaaatactgtacgaatggcttcccgccctccgggcgcgtccgaagcgccagcgtgttcacaaacatgccgagtatcgtctcaagatccttgtgcggccggccggcgattggcgagccgacgatgatatcttcctgtccgcttaagcgtgacaagaacgcggtgtaagccgcaaggagcaccatgtacagggtgcttccgttttctcgtgccagcttgtgaaggcctgatgcaacctcttgatccagcgtaaatgagaccttgtcaccagcgaagcttcgcaccggcgggcgggcatgatcagcggggagatccagcacaggcagctcgccctcgagctgcttcagccagtacgcctcttgcgttttgtacgcgtctcctgttttgaatccttcttgccatacggcataatctttatattgaatgcgcagcgccagaagcttccgattattgtacagctcgccgaattcttgaatcagaatgttgacggaaacaccgtctgaaatgatgtgatgcatatcaaccagcaacaggtgccgctcatctgatacctttacgatttgggcacggaacagcggcgcttggctgagatcaaacggtttgataaatgcggctgcggcctcctgttcggttcgttcgccgagaactgtagtctgtaacgtaaacggcacctcgtcatggatgcgctgcaccggatcgcctccttcgtcctgttcgaaggcggttcgaagcgactcgtggcgcttgatcagctcttggaaagctctgtccatcctttcagggttgagcttcccttcgagctctaacacagccggcatattgtagcctgtccctccgtcttccagctgctgaaggacataaatccgcttttgggcagaggaaaccggataggtttcctgtttttcagcgggcttaatcgcttcatatggactgtccgttccttcacggataacggcagccagtccttctactgtcggatgggcaaacacatcttttagcggcacctgtacatcgaattctttggcgatccgtgagacaagcgccgttgcttttaaggaatgtcccccgcggtcaaaaaagttgtcgtgaatcccgacagggccatttttcagcacgtcctcccacagctgagaaagcttcatctcagtcacgtttctcggcgccgtgtaggtctccgcatctgccgctccgccaggagctggcagggcgtttcggtcgagctttccgcttggcgtaaccggccactgttccatctctatcatataggctgggaccatgtagcccggcaacagtctctcaagctgtgcacgcacttcgtttctttggagcccttctacataagcgcataattccggctccccgctgtctgtccgtacggtaacagccgcctctcttacgccttctatgcttcttagtgccgcttcaatttctcccggctcaatccggtagccgcggatttttacctgatcatccgtgcgcccgaggaattcaacattcccgtcagggagccagcgcgccacatccccggttttgtacatgcgttcccccgggtaaaacgggtcttcaagaaaacgctcctccgttaatgccggccgattcaaataacctctggcaacacccgctccggcaatgtacagttcgccggcgacaccggaaggctgtacggctaaatgcggatctaaaacatacaaacgcgcaccgggtacgggcttcccaatcggaatccgcaaacgatccctgtcccgttctggatccaatacgtaaaatgccgcgtctaccgttgcttctgtcggcccgtaaccatggattaatgatacctgcggcaatacagaagcaaaacgggctgccgtacgcggcgcaagcggttcacctccggcgaatacacgcttcaggcttgtgctgtcacgcaacctttcgatttccgcttgatcgagaaagctgttcagcatagccggaataaaatgagccgttgtcacgttttcctgatgaatggcttttacgatcaatgccggatctttctcccagccgggcggaagcagatacgccgaagcaccggaaagcgaccaccaaaacagctgccacacagacgcatcaaaggaaaaagaggttttcaccatgacaatgtcatcttccgaaagcggaaactggtgctgcatgcctgtcagaaaggaaacagcctggcggtgctcaacggccactcctttcggctgcccggtagagcccgatgtatagatgacataggcgagagatccgccgtcagcaggagtaaactcatggttttctgctttttcgctcgcaagagatgtcatgtccacttcaagcgtttcgccagaaaagtttggtgcggagcatcccggctgtgtcagcaagagcgatgccccgctgtctttcagcatgtagctcagccgctcctttggatacgcaggatcaagcggcaaatacgcccctccggccttcaatacagcaaggacagcgatcagcatgtcaggtgaccgttcagacaggacaccgacgatactttcgtttgtgacgccgcgtgccgcaaggtgcgcagccagccggctggcgtacatatcaagctcagcgtatgtcagcgaaccgcctgaaaagcgaatggccagccgctccggtgtgaaagctgcctgtcgctcaaacagcccatgcagggtgaaagctttaggcgaaacagcttccgtcttgttaaactcatacaacaatttttgcttttctcttgtattcgtcatatctaattctcttataaagctgtgcggatgttgaagggcgttttccagtatggtaagcaaatgagattgtattcgtttaatatcctcaagagaaaacaaggtattttgatagtcgaaatttaattgaatggttccattgtctatccgttcttgtatttgaactgaaagctcattcgcggtgtatccgctgaaataaagcgctgtttcatagtcaaaatcatctgcattatgccactgaagtggctgatactgcatagatataccgataaggttgtgtaaatccttctgttcatttcttaattcatttacaagcaaattataaggaaaccgttgatgacgcataacagaaagctgttccctgcctattgtgcgcacaaaggaaagaaaatctgtgtcaggatcaaccgttattctgattggaagggaactaacgaacatgccgagcatttctttttcagcctttgaacctctgttgccatagtaggtgccaatggcaagatcttttttagaagtgattctgctgatgcatatgtaaaatgaagccataaataaggaaatgatattgatcttgtgttcttcgcagaagattcgaatcgtttgctctagatcaggtgaaagaatgatggtgtctctggatgcagatgtgctctgtttttgtaaggacgtctggtcggctaacgagtggtattccaacgggtgctcaaaggtttgtgtccaaaataaacggtcctttgcaaaccgcggagattgtagatattgactctctttttcgatgtagctcaagtaagaaggttccggctgatcaggtaaaggatctttctttttcattttttgataaagatctataatttgatttcccatcacatttaaagagattccatccattatgatatgatggaatttcgcaaatagccaaacttcatgagagtcaattctaaggaggtaaaattgaaaaagaggcgagttgaacagtttaaatggaatgctcgcttgatcctgaatccattgctctatttctatcatttcaacatttgaaaaatcaattattctaagtggataatatttatattcagtaaggtgcaatcgcggctcaagctcttctccttctaacagctgaaatctaatggcgtcgttgcgggagatggaatgattcagtgctccctccagagtatcaagctcaatattgcctttaaatttcacacaggctgtgagattgcaaatactggtatctggctccagcagttcggtaaaccacactctcctttgggcatgggttaaagaataagtatgttcgctcaacggattccctccagttctcataataagaggataagaaaatgtagaaaaaagcagaaaaatgacaataaaagaaattatatgactatataatccatatatgcactatattaacggatattttttaaagtacaataaaaaacattaaatttttataacatttttttgaatatagtattatttctttatttttcgtttctttttttatcaaatttccggatataaagtgataaaagtattgttttacataaggtcttatacactactttttaatcggactaatttgcttttgcccatcattcttctaattgttggaaggttcgacaaagcgttattacagacataaaaaaacctgttttctcttggaaaacaggtctgccgctattattgatttgccaaaatgacagcgatttgatcctcaatatcttttccatcctcttcatcaatcaatccatttagaagaatagagaaaacaagtttttttccgctctttgtttctgcgtaccccgatagagagcttaccgtactgagcgatccggtttttgctcttacttttccttgtgcaggagtgtctttcatgcggtttctcagcgttccgcccaccattctgtcaggattgcccgcaacaggtaaagaatttagataagccgagaaccaactctgatcctgaatgtcatataacagctgtgaaagttgatctgaggatacagcatcaatatgtgagattcctgatccgtctcttaagacgagtgatttagaatcaacaccaaattccggaagcgtactgtttaacacttcgagccccttttcccagctcccttctccttttttcactttccccatctcttttacgagcacttcggcatgtccgttattacttaatttcatgaacggcacaaaaagtttcgataaaggcattgagcgatgagagagcagcacatctgaagaactaggtgcttcacccgtcttgatgtcccctttcacagtaataccttgtttttttagtgactgcttaaataaatctaaggcatatccggcaggctcccagacagaaatccattcctttgtcttgtttgcgtcaaccggtacgctcccttcaattgtaatcgtgtttgttccatgctctctttcgattgtgaggtctttctctgaaccggcagcagtcgtttcagcatcgttctttatcgttatataatcggttttcggagagacagacacggcaggctcttccccttctttttgatttggggtgacctcaacaatcacagtgcctgcatcatagtcttcgtttggagacgctgttagagcggagattggcgcgccataatatgtgtattcatcgctccaaggcatatcaggtgataatcgcatgtcatcatgccacgtatcatcaccgatcagattgcctttaattacttttacgccggaatgtttcaatttctcagccattttgtcaaaatcagatggtaaaagtgtcggatcgcctttccctttcaaataaaggttaccattcagctttttccctttcagtgttccatccgtccggacctcggttgtaaaagaatagttctcgccaaggacagaaagtgccgcggccgctgtcaaaagctttagagaagaggcaggcctcattcgggtgtctcctgaatgttcatatagaacagcacctgtttccgcagagcgaacggtgatgccggccattgcgccttcgagggcaggatgatcagctaaaatcttatcgatctgcccggaaagtgcatcttgtttttcagcggcaagcgcagcctgatgcatataaggcaccgaagcaacgacgaaaagcagtaaaacagcaacataaagctttatgctttttttcattcatttccccgcctctctgcgcttcatcattggctattgatgattcagttcaatggtgatactgcttttagctgtcgtttcttctcccggctccagcacttgtaaaccagtgagtgacgaaggtaaatcaagattcactgcgtttgtcacccatgtgtaaggctcagggcataaatacccttgttttccgtccgcattgtatacaacccaatgtttaaactgttcatctgccttataaataatgctattatgtgcatgctgatgataaatgactgcctggttttctccgcccctcttctgataagaagataaaaagacatcatccagctgcttgtggcgcaaatccattccttcatgcaaagcttctttatacgggacatccatcagtttccctgtcggcagcaggcgttcatccaactcccattgctgatctgctgtcagggaaaataatgagctttctgccggaaatataaatgtagtatgataaccaattccccaaggaaacgcttcctttcctttgttcatgaccgtcgcatgtttaaatagagtattcccctttaccgtgtatgtcatccgaacgacggcatggtgaggaaattgcttatacacatgggggagcccagaaagatcaatttctgtttcaacaatcacttcttcatcagttttcttcgcggtcactacgttccacttttcatggtaaagaaacccatgaagatggttgtgtttatccttctcgttgatatcaaaatgatacgttctgccccggaaactgaatgtaccgtcacttatgcggttaggcgggaacaggattggaatgccatacaatgttggtgtgtcgtgaaaactttctgctgtttccggttcacgcaaaagctggacatttgttgttttgtccacgagagaaatgacgttgctcccccactcagggacaacaatcatttctagatgttcgttgcccgctttgatggccggcgttcccaaatacgtgattttctcaataaagtttgccatgtttactcaacctctccttgattcattgctagtataagaattcaatgtactgtaccatatttcctccattttatattttcccctatcaaataaaaaaacaccgttcaaacttatgaacggtgtgattcggaggctattggatgagacgtgtgatttgtttctttttccagacgaattgataatacccataaatcaacagcaagctgacggcaaacgcagctggataaccaacccagacgccgagtatttcaagctttgtatagtgagaaaggacgaaagcgacaggcacctctactccccagattgcaaaaatactgatgacggtcggccataaaactgttccgcttgcccgcatcgttgcagaaataatttgggcatttccaaacagcaaatagctccacaatgtaatcatcaaaagacggtgcgcaatgtaaagcgtctcttgctcggttaaaaataacgataaaatctgatgtgaaaaaacatagatcagaatgatcagtacgccgccaatgatataattcagccaaatccccacgcgaatgacctgctttaagcggtcaaactcgtttgccccaatcgattgcgcagcgaaaatagaaaccgcaataccaaggctgacggccggcatctgtacatagctggctacctggttgaccactccgtatgcagctgttgcattagagccgtaatgattgacgaatgaaataaccgctatctctgataatgagacaagaatcatattgatgcttgctgggaccccaagacgcagcaggagaaccagcagttccttatccattttcaaataacgacgcactgttttatcaaattgcagcgggtgttttcgctttcgtaaatacaccattaacacgagaaaagtcgcaatcgtggaaatgacagttgcatatgccgagccgtatatgcccagtttcggaaaaccaaacatgccaaggattaaaacaggcaaaagcgcgatgttgatgaccgtgctcacaatcagcgtataaaacggtgtcttagaatcccctgttccgcgcaaaaaggtagtatatgcaaaatataaaaacataaacggcatagcataaaataaaatacgtgcatagttagcgctgacatgaatgacattttcaggcgttcccattaaacgaaggatatccagggtgaaaatactgccgatgacggctaacacaacgcctaataaaaatgtaaacgtgagcgtcgtcccgacaacagcctttagccgttcctcatttttcgctccgtaagcttgtccgatcagaatcgaactacctgaaccgatcccaatcgtaaatgagattaaaagaaaaaataacgggaaaaaggatgatacagctgccactgcatcaacaccgagccatctgcctacagccatcatcccgactagctggccgactgattgcagcacattgctcagcagaagcggcaccaaaaagagtgacatcgaccgccaaactgatggtttgcttttcttttgagttacaagaggttcttgtgatgtttccatattaaaggactcctttatttgaaatcgtttttaaacatgccctcattttttgacaaaaacaggatatgcaacatgttattattcatcactgcacatatgaaacccttcccgattcttctaatttcacacatctttttagcttatgaagaataaactagcaagtaatggcgtattttttgtgagtaaaagaataaaaaaataatttatgcaaaagtattgtaatctatccgtaattattgtaacatttgtaacataagagaaagagattttgaaggagagagcgataatgaaaaaatgtcttctatttctaacaaccattgcacttattctgtcattaagcacaaatgcatttgcgaaaaatacatcaggcaatttatcacaaaaacaagcattacagttggcattatccgctagagaacatttttggaacaccatgagcggccacaatccgaaggtgaaaaaagcagtttgcccatcaggcacattcgagtatcaaaatcttcaatatgtatacatgtgcagtgatctaggcactaaagcaaaagcggtgaattatttaactcctatttttacaaaaacagcaatcgaaaaaggctttaaagattatcatttcactgtttcaaaaggaaaacttgctgttccaatcggtgacggagacaatcttttgaattggaaaaaatcaactgctaaactgatctctaaaaaaggcagcacaatcacatacgaatttaccgtccctacattagacggatccccttctgcaaaacggaaagtgacatttgtgaaagaaaataaaaaatggaaagtcaatcaatttgacgcagttatataagaataacgcccggtataagcgggcgttttttatttggtctgcataaagaaagacaacaggcgaaaagtgcctgttgtctttttgtgaatataacgctctaggagagattcgaactcccgacctgcagtttaggaaactgctgcactatccgctgtgctactagagcttttggtatttatatagtagctctgatgatcaatattttcaagcgatttgtattaaagccctccaaaaaccttatatgcggctcttgtcgtatcttcatcaataccgatataccgcattgtaattgatggtgatgaatgattcagtattctctgcagctcggcgatgtctttcgttcgctgataaaaatgatagccaaacgttttccggagtgtatgcgtccctatctcctcaagtccgcacgccgcagcggcctctcttaaaattctgtaggcctgaatgcgggaaatcggcttcctggtgcgcactgatttaaaaagatattcgttttccttcatgtctttcgtatactcgtatatttcctgtttcagcgattctaaaataagaatctttcttttctttttcgttttgctttcagtcgcccataaatgatctttattttgaacgtccttcacttgcagcggcagaatatcagaaatgcggagcgcgctgttgatgccgaaaataaacagaaaataatcccgcttgtttttgttaagcaaatactgtttgacttcttggattttctctagactgcgaatcggctgtacaatatgcatcaaaaaactccttaaaaacagttatgtaacgttttgaggtctatgttactattatagctgaaaaacgttgaatgtcaaagtgcggcggcgtttatgtaacataatatacatagtgttacataagcttttaaaaaagcttcttcaaaccttcaccctataaaataagctttaaagcctcttataaagcttttaacctcttggatacttatccccctactaatcatcaaaaatcctcttaaaacgcaatctgacgctcccaattttctggagcttccgcaaaaaaacataaaaaaaagacacaacttcaaattgtgtcctaatcctcatcctttacatcaatatcttccgggattggttcatttaatatttcctgcacaagtgctttgtaattctccagctgttcgagatgcgttttgaactgctctttataaatcaaaaattgctctccgtcatgaacggctctgattttcccttcgagcaccaagcttttaatataatcctctgaaagatttgtatattctgctgtttcttcaatcgttaaatacatatagcagtcccttcttaatccgtatgctgattctaatatagcacatggctcatatcaatataatcaattttgcacagaaaaacggcattatgcactatataatataccatttgtcacttgtgaaaacgctgtaatttttttacgctaagattgtaacaatacagcttcatataggagggagaacatgaaaagaacgtggaacgtctgtttaacagctctgcttagtgttctgttagtcgctggaagtgtcccttttcacgcggaagctaaaaaaccgcccaaaagctacgatgagtacaaacaagtagatgttggaaaagacggcatggttgcgaccgcacatcctcttgcttctgaaatcggtgctgatgtgctgaaaaaaggaggaaatgctattgacgcagcggttgccattcaatttgcactcaatgtaacagagccgatgatgtcaggtattggcggcggcggttttatgatggtgtatgacggaaaaacgaaggatacaacgataatcgacagccgtgagcgtgctccagcaggcgcaactcctgatatgtttctggacgaaaacggcaaagcaattcctttctctgaacgtgtaacaaaaggtactgccgttggtgttccaggcactctgaaagggctggaagaagccttggataaatggggaacccgttcgatgaagcaattaattaccccttctattaaactcgctgaaaaaggctttccgattgattcggtgttggcagaggccatttctgattatcaggaaaagctttcacggactgccgcaaaagatgtatttttaccaaatggcgaaccgcttaaagaaggagatacccttattcaaaaggatttggctaaaacatttaagcttattcgctccaaaggcactgacgctttttataaaggaaaattcgccaagacgctttctgacactgtccaggatttcggcggatcaatgacggaaaaagatttagaaaattacgacattacaattgatgaaccgatttggggagattatcaaggctatcaaatcgctactactcctcctccaagctccggcggtattttcttattgcaaatgctaaaaatccttgatcattttaacctttcacaatacgatgtccgctcatgggaaaaatatcagctgcttgctgaaacgatgcatttgtcatatgccgaccgtgcgtcttacgcaggtgatcccgaatttgtaaatgttcctctcaaaggcctgcttcaccccgattatattaaagaacgccagcaattaatcaacctagatcaagtgaataaaaaaccgaaagccggtgacccttggaaataccaagaaggatcagcaaactataaacaagttgaacagccgaaagacaaagtagaaggccaaacaacccactttacagttgctgaccgttggggaaatgttgtttcttatacaacaacaatcgaacagctattcggaacgggtattatggtccctgattacggtgttattttaaacaatgaattaacggattttgatgcgataccaggcggagctaacgaagtacagccaaacaaacggcctttaagcagcatgaccccgacgattttatttaaggatgacaagcctgtcctcacggttggatctcctggcggggccacaattatttcatccgttttgcaaaccattctctaccatatagaatatggtatggaattaaaagcggctgttgaagagccgagaatttatacaaacagcatgagctcttaccgttacgaagacggagttcctaaagatgtcctcagcaagctaaatggcatgggccacaaattcggcacaagtccggtggatatcggaaacgtgcaaagcatatcgatcgaccatgaaaacggcacctttaaaggtgtagctgattcaagcagaaacggcgcggcgatcggcattaatttaaaacgtaaataaattaaaaaactgtactcgcttcaaatgagtacagttttttatacacatctttaaaataaaaactgacaaacgtctttattctgctaatgcacgtctatcttcatcttttcatttcgtttatctcatcaagaaatgtctgaaacgcactcgtaataaaaaagtctttcctgtatataaagacgatctctaagtcttgatatgctggtggcagctgatgaatccatacatttgtacgatgctcggagcagtcaacagcggactttgggagcagcgccgtacccatcccggcggaaacaccttttataatagcctccaatgtgccaaactctatgattttttgattgtgtatgcctgcttcctctagtaatcttttgaccctgtcacgatgagaacagccagccccaaaaaagagcatcggctgctgaagcatgtcttctgccgtcccttctcgtgatgaaatcaaaactaattcatcataggagacatggagttgtctaaccgcagcgtgttcaaccggcccatatacaaaagcgccatcaactttatgatcaagaacctgttgaatcaaatgatgcgtatcagctgtgttcactgataaatccacttcaggaaaacgcctgaggaaggatgctgcatgctcaggcagatgcgttaccgccgtcgtttccagtgatccgatccgcaaaggcccttttggttgcctgctcattcgggtcgatttttcagcttggtctaacagcgataatacttgatctgcatattgtaaaagattttctcctgcagcagtcagcttcattccccgattcgttcgatgaaaaagcctgatattcaaatcttcctcaaggttatgcactctggctgtcacattcgactgaacataattcagcatttgggctgctttcgttatgcttccttcgcgggcaacagcctgaaaaatctttaaatctccgctttccacgcgctctcacctgcttgctatgatgaaaagtgatattggctatcatatttgttcattttactcgaagaaaaccgctatgtaaaatatgtaaagatatgaaaatacaattcaatgaggaggcagacagcatgaaagctataattcacaacggaaaagccggtcttctggggttatcagttcaggacgttccatcaacaaagcctggatacggagaggtaaaggttaaattaaaatctgcaggcctgaatcatcgtgacttgtttcttatgaaaaacaaatctgaacaagatcctcacataatactgggttctgacggcgcgggtatcatcgaagagattggtgaaggcgtgaaaaatgttactgttcagacagaagtagtcattttcccgacattgaactgggatttgacagaaaatgttccacctgtacctgagattctgggaggtccttcggacggaacacttgctgaatatgtgatcattccttcacaaaatgcaatcaaaaaacctgcttatttatcttgggaagaagcgggcgttttacctttatccgctttaactgcatatcgggctctgtttacaaaggggcaattaaaaaaaggcgagcatctattgatacccggcatcggcagcggtgtagcaacctacgctttatttatggctaaggcgattggggcaacagtaagcgtgacctcccgcagtgaggagaaaagaaaaaaggcgctgaaattaggtgctgattacgcatttgacagctacagcaattgggatgagcagttgcagggaaaaaaggcggatgttgttcttgacagcataggacctgccctcttttcggaatacttccgccatgtaaaaccaaatggccgtattgtcagctttggggcaagctcaggggataatctcagttttccggtgcgttctctattctttcctcaggtcaatgttttgggaacctcgatgggaagcggtgaggaatttcaagctatgctcgctttcattgataaacataagctgcggcctgtaattgaccggatatatcctttagaaaaagcatgtgaagcatataaaagaatgcaggaaggcagacagtttggaaacatcgggatcgtaatggaataaaaaaagaaaccggctggcagccagaccggtttctcttatatgataatcccctttatttacggaagaactgaactccccatcaaatatcgatccacttcacgcgccacttctcggccttcattaatcgcccatacgattaagctttgccctcttcttgcatcccctgcggcgaatacaccatcgatatttgtttgataatccccatatgctgcactgattttgttatttacagaatcaacaccgaactgtttcaacagcggctgttctgtgccttcaaagccgatagcgataaagacaagctgagcaggccatactttttccgttccaggcagctcgcggaactcgtatttcccatgctcatttttcactttttccatttggatggtatgaagctctttcagctttccgtttttatccgcaaccatttttgtcgtttgaatggagtattctctcggatctcttccgaattttgcttctgcttcctcgtatgcatattcaagcgtaaagacgtgtggctgttcaggccacatattgtcattcgtgcgggctggcggaagtttcgggtgtttgccgaattggtgcacgcttttggctttttgacgcagagcagtagccacacagtcagctcctgtatctccgcctccgattacgatgacatccttccctttagcatcaatgaattgcttgtctttaaaattagaatctaaatagctttttgttgcaagtgtcaggtagtccattgcgtaatggactccttttgagtcgcgtccttcaattaagaggtcccgctgtttttgagcgcctgtgcataggatcacagcatcaaattgctcctttagctcatcagctgtaatatcaacaccgatttctgtgttcgtgacaaaatcaattccctcttgcgtcagcaatttaattcggcgttctacaatgcccttctcaagcttcatgtttggaatgccgtatgttaaaaggccgcccgctctgtctgagcgctcaaaaacagtgacagaatgccccgcttgattcagctggtcagcactcgccagtccggctgggcccgacccgacgatagcaacttttttgcctgttcgtttttttggaattctaggttgaatccagccgttctcaaatcctttatcgataatggtccgctcgatgtttttaattgatacggccgggtctgaaatcgctaaagtgcatgatccttcacaaggagcgggacatacccgccctgtgaattcaggaaagttgtttgttttcaacagacgttccaatgcttccttccatctgccccggtagacaagatcattccattcaggaattaagttgtaaatcggacagccggatgtaaatccgttaatgtccgcaccgatctggcaaaacggtgtaccgcaatccatacaccgcgccccttgccgtttcgatgcttcttctgaaaaaggagcagaatattctttccaatcctttaagcgagtgagagggtcccgctccgcaggtttttctcgtttgatctccataaatccagttggtttccccatgttcctctccccttccttactgtactaccgcttgtttttgtcccgatgctgctgtattctgctttggcttcgtgttggcctcaaaagcgaacatgatggcttcttcatctgataaacctgcagctttttgctcttcgatgcttgcgagcatttgtttatagtttttcggaatgactttgacgaattttttcacactgtcttcccattgatctagcagatcttctgctttttggctgtttgtatacgcagtatgtctttcaagcattgctttgatttgctggatttctttctcatcctctaatgattcaaataaaatcatctcaaggttgcatttgcgtttaaacgctttgacatcttcggtcagtacataagcgattccgccggacatacctgccgcaaagtttttgcctacatcaccgagaacgacaacgctgccgccagtcatgtattcacagccgtggtcgccgatgccttctacaactacgttcacaccgctgtttcgaacggcaaagcgttcaccagcacgtccgttaatatatgcttctccgcttgtcgcaccgtaaaaagccacgttgccgataatgacattgtcatccgaagcagagttgaatccttctggtgacttgacgatgatttttccgccagaaagcccttttccgacgtaatcatttgagtctccgtctaaataaagcgtcatccctttaggaacgaaagctccaaagctttggccggctgatccggtaaagtgcaacttgattgtatcttcaggaagaccttcttctccgtaacgctttgagatttcactgccggttatcgttccggctacacggtttgtattgttgatttcgatagaaacttccgcttcttttccagattcgatggcttcttgtacggccgggagaatcgctgtaatatcaagtgattgatcaattttatgattttgcggcgattggaacgtccgcaccccatcaggctgataaagaagggtagacaaatcaagctggcttgctttccagtgctcctttgcccgttcacttacatgaagtacatcagtgcggccgatcatttcatcaaatgtcttgaagcctaacgcagccatatactcacgaacttcttcggcaatgaacagcatatagttcacaatatggtcaggatctcccatgaactttttgcgaagctctggattttgtgtcgctacaccgacagggcatgtatccaaatggcaggcacgcatcatgacacagccgagtacaactaacggagccgttgcgaaaccaaattcttcggcgccgagcaaggcagccatcacaacgtcgcggcccgtcatgagctttccgtctgtttctaatacaacacggtcacgaagtccgttcagcattagtgtttgatgtgcttctgcaaggccaagctcccacggaagccctgtatgtttaatactggttttcggagaagcgcctgtacctccgtcatagccgctgatcacaatgacatctgcagtcgctttggcaacacctgcagcgattgttcctacacctgcttttgacaccagctttacgctgattcttgcgtcacggttggcatttttcaaatcgtggatcagctgggctaaatcctcaatcgaataaatgtcatggtgtggcggaggtgagattaatccgacacctggcgttgacccgcggacatcggcaacccatggatataccttgttgccaggaagctgcccgccttcacccggcttagcaccttgagccattttaatctgcagctcatcagcattgacgaggtaatggcttttgacaccaaaccgtccggatgcaatttgtttgatcgcacttcttctatcatcgccgttctcatctggaacaaagcgtttgggatcttctccgccttcaccgctgttgctttttcctccaagacggttcattgcgattgctaaagcttcgtgcgcttccttactcaaggacccgaatgacatcgcacccgttttaaaacgtttgacaatcgattcagcggattcaacctcctccaacttcaaaggcttgcggtttccgtcaaatgcgaacaagttccgcaaaaatccgatgcgttcttcatcagccgcttttgtatactgtttaaacagattgtaatcatttctgcggcacgcccattgcaaagtatgaatcgttttcggattaaacgcatgatgctctccgccatttctccattgaaagtcacttcccggttcaagcgttttgctgtaatcatcctgatacgcttcccggtggcggcgctgtgcctcttctgcaattgtttgtaaatcgatgccgcctagctgtgatgcagtacctgtgaaatagcggtcgatcacatcgcggctgattcctaccgcttcaaagatttgggcgcctctgtagctttgcacagttgaaattcccatcttggacatcacttttacgacgccctcagtaatgctttttccatatttgctgaccgcttcttcatagctgatatccaaacggccttcatcaatttcctgcttgtaggtcgcataagcgagataagggttaatcgcatctgcgccataaccgattaacgctgcaaagtgatgcacttcacgtgcttctcccgattccacaataatgctgaccttcgtacgcagccctttgcggattaagtgctggtgcagcgcgcttactgccagaagcggcggaattggtgtcagtcgttcgttcatctttttgtctgataaaattaacaaacttacgccttggctgatggctttctctgcttgtgtgaacatgtcctttaatccgcgttcaagatcctctgaaaacagcacatcaattttttggctttttaaatctggatgaacaatcgttttcaatgcgtaaaactgttcattggataaaacaggtgtatacagtttaatccggcgaacatttcgttcacttggatgaagaagatcgccttccgcaccgagccaagtcatcgttgaagtgacaagctgctcacgaatcgcgtcgattggcgggttcgttacttgtgcaaacagctgtttaaagtagttaaacagtgattgcgctcggtcagatagtacagcaagcggagcgtcattccccattgaaccaaggggatctttgccttctttaataacaggaattagatacttttggatatcctcatatgtgtatccgaatgccttctggcgagtaagaagatcactaaattgttcttcttctcttgactccggatcaggatttacttgtacaagctcttcttcaagccatttttggtacggatactcagttgcaatttgtgttttgacttcctcatcggagataatacggccttcttccaggtcgattaaaagcattttcccaggctcaaggcggtttttatataaaacgttctcctgttcaacttcaataacgcctacttcagatgagaaaataatataatcatcttttgtgacataataacgggccggacggagaccattccggtcaaggattgccccgatttgtttaccgtcagtaaatgaaatggctgtcggtccgtcccaaggctccatcagggagctatggtactcgtagaacgcccttttttccttggacatatgcgtattttccgtccaaggctctggaatgagcatcattgccgtatgtgccggtttgcgtccagccatcacaaaaaactcaaatgcgttatccaaaatggaagagtcactgccatcagcattgagaatcggcaaaatcttgtttaagtcctcaccgaagctttcagaaacaaattgctgctcacgtgctctcatccagttgatatttccgcgaagggtgttaatttcaccgttgtgaaccaaataacggttaggatgcgctctttcccatgtagggaatgtattggtactgaagcgtgaatgaacgagcgcaaaagcagaaacgaatgcttcgtcttgcagatcagaataaaatgcatcaacctgttcaggtgttaaaaggcctttgtaaacaatggtctggcttgaaagactggcaaaataaaaatcaagatcttccgttactccccaattttcagcctgtttacgaatgacatacaattttcgttcaaaagataaattgtcctttagatcagaacttgcgccgataaatacctgacggacaaacggacagcttttttgcgctactgttccgatttttccgacatttacaggtgcagttctccatccaagaacgacttggccttcttgttcaatcagtgcattgatttgcttttcaattttttttctttcatcttctttctgtgagaaaaagaccattcctaccccgtaacgttctttttctggcagattgatgtctttgcactcttttctaaagaaagcatcagggatttgaaccagtaagccggctccgtctcctgtatccggatcactgccttgccctcctctatggtctagctggcaaagcatcttaagtccttgtttgacaatgtcgtgagtctgcttgccctttaagtgtgcatataggccgattccgcatgcatcatgttcaaattcaggacggtagagaccttgagcttttggcatttgattgtacgtcataattcctctcccccgatcaatttccgataataccggtcataaaatctaacaactctataatcattgtaggttttcaaaacgatataaacaatatataatttagatcaaaagaatctcaaaatgagatagatggatgtgagacaaacatggagctgcgccaactgcgttatttcatggaggtggctgaaagagaacacgtttcagaagccgctgatcatttgcatgtggcccaatcagcaatcagcagacaaattgccaatcttgaagaagaattaaatgtgaccttatttgagcgtgaagggagaaatatcaaactcacgccaatcggaaaagaatttttgattcatgtgaaaacggcgatgaaagccattgattatgcgaaagagcaaattgatgagtatcttgacccgcatcgcggaacggtaaagatcggctttcctacaagcctcgccagccagcttttgccgactgtcatttcagcgtttaaagaagaatatccgcacgtcgaatttttgctgcgccaaggctcctataagtttctgattgaagctgtcagaaaccgcgatattgatctggccttattaggaccggtgccgacgaatttctctgacataacgggaaaaatattatttactgaaaaaatttacgcgcttgttccattaaatcatccgcttgctaaacaaaaaacggttcatttaatcgatttgcgcaacgaccaatttgtattgttcccggaaggatttgtacttagagagatggcaattgatacttgcaaacaagcaggctttgctcctctcgtttccacggagggtgaggatttggatgctatcaaagggttagtgtccgcaggaatgggcgttacccttctgcctgaaagtacttttgctgaaacaacacctcgttttactgtgaaaattccaattgagttccctcaagtaaaacggactgttggaatcattaaaccgaaaaatagagagcttgcgccttctgcgaatgatttttatgagtttgtcattcaatttttctctaagctggagcagtatcaataaaaaaatgaacccgagcttctatatagaagcttcgggtttttttctgcaaattaatttacaggtaaagaaaaatccacatggcaaacaaaggcttcttgatcaattagagctctgtttgtcagttccttgttcttttccggttcttgaagctgtacagaagagtaattgacgattccaaggccgatttccgtcccttttgaatccattagccgaacaactgaaccgcttttaaatttccctttaatcttctgtacaccgtctaggtataaactcgattggccgtttgttatttttcgtgaacaatcatctgataaaatcatttcaccttccggaccggaattaaaagcgatccattgctccttttgattcaacggaagcgttccttctgcttcaaaataggtgccttccgcctgttcatgaacggcgtgatataaaatatcgccggcatctgcctgaccaaggaaacctttaatgccagacgccattacgattttaaacgcatcaagcttagagcgcatgccgccggtgccaacgatgcttccagtgtcacctgcgcatgcttcgatgtcaggtgttatttcactcacccgctgtatccttttcgcttctggatttgtgcgcggattgccgtcatataatccgtctatatctgataaaatcacaagcatatctgcatcaatcaatcctgcgacttttgccgcgagtgtatcattgtcgccaaacttgagccgattgacggtaactgtatcattttcgtttatgatcgggatgatgccgcgctcgagcagtacattcattgtattcctgacattgttgtatcgatattcatctgaaaaatcgcttcttgtaattaaaatttgggatgcgacatagccgtgtgccaaaaacagctttgaataagcctccatcagcaatccctggccgattgaagctgatgcttgtttttctggaagcttctcgggcctttggataaatccgagtttccgatatcccgccgccactgcgcctgaggaaaccaaaattacttcataaccggcgtctttgagtttgacgacctggtcgaccaacgcttctaattttcgaatgctgatttctccatgaaggcttgttaatgaactgcttccaatcttcacaacgactcttttcatgcttgtatcaggcgtcactttatcactcctgatagcggcgctgcagttttttcgatatcttcgctgatttcctttgaacgcttagccgcatgctttatcgcttgagaaatcgcttctccgccgccgctctttttcaaggcttgcagccccgctgctgtcgttccgttcggtgacgtgatattatctcttaagatctcaggatgttctcctgtttccatgagcatttttgcggcacctaaaagtgtctgtgcgccgatgcttcgagataactgtttatcgaggccagcttcctcgcctgtcttttcaatgaattccattaaataataaaaatacgcggggccgctgcctgcaattccggtgaatatatccatttgattttcttggattgtatagacttcgcccatgcatccgagcaatgcttcggccagcttcttcaggtcttccgacacatattttccaagggcaatagctgttgcagaagcgccaatcatactggaagtgttgggcatcactctgacaaccggctgttcattaagcaatgattgttcaataaaagaggtagttatgccggcaaggaccgacaatattaattgatggggttgaatacgtgattttagtgatgacagagcgttttcggcgtcttttggcttcattgccaaaatgagcacatccatgtcttcaatacatagttggttcggcaaggcgcctttaatgccatattgaagttcaagttcagttaatcgctctgtattgctgcggtttgtaacgcagatgttttgtttcgggattttgttggcacgaacgatacctgatatcattccttccgccatagatcctgctcctataaaggctactttcttttgatcaaagatcggtaacatctcctttgttcgcttttttgttcgcattttcacacgtttaaaatgttaccacgtgaggaaatgatgtcaagtttgaaggtcatcattgatttgtattgtttcttttcgacaaatatgtataatgaaaagcagaaaacacccggttcacactgctgcgccgggtgtttgtttctattaaaaattatctgagagagctttttcaatcagttttttacagcgatccagctctaccttcagctgttttttatatagcttggcggcttcgtaatctttaaattgatagaggacgacttcctggagcttagccccttctttttttactttaatttgttttagtatcccgtcatcaagaagctcatgcaaagaccggtatacttctgtatgatttggtttaaaaccaatctctttaaattcagaccgaagtacttcaagcagctttaacccatagagtctctcttgctctgtcatcgttatcatataaagcttcaaaaatgcgcgctgtttcactaaaaagcctgttgaactccttttttcttctttcatcatatgcactccttcttctgtcactgacaacactatgtactaaatattcaattttcttttattgttttccttctttatattaaagactgatagtccagtcatttcatatttactgattataggtgtagcggaaaaaataaatttcgactgaacatttggtacatagttttcttagttctattatagcctgcattcactgccagcttcaatttaaaacgattgtcagatttgcatatgccggtatgaatttcattcaaataaaaaaacctgtcgaaagacaggttttcatttttaaggatttgttgaccataatcccgctgttttgatgaaaatgcgtggatctaatttcaattgtgccaccatgtactcagcaagatcctcaggctgcatcactttttcagggttaccgtctgttaagttcaattcgatagacatatcactagcgacagtgctcggcgttaacgcgctgactctgatattatgttttctcacttcttgcataagagactctgttaaccctagaacggcaaatttagaagcgctataagcacttgttacagcagctcctctttggcccgctgtagacgaaatattaatgatatctccggctttgcgttcgatcatttccggaagcaccgcgcgagtcacatgatacacacccattaggttgacttgtataatattttcccattcatcggctgacagatctaagaaaccgccaaatttgctgattcccgcgttattaatgagaatatcgatatcaccaagctgttctttcacttgagcgacggcttggttaacctgctcggcatcttttacatctgcagcagcaaatgcagcttttacaccaagcgctttgacttcttctgccactttttcaacattagcggcagtccggccgattaacccaatatttacgccttctttcgcaagagcaagagctgtagcacggccgatccctctgcctccgcctgtgattagtgcagttttatgttgtaaactttgcaattgaagcaccctttctttgtttacatatgtacgatatcacattataagtacaatacatccaatacgcaaatcaaacgaactgtgtaaatatcatttcttctgattaaaaaagcggatacagggtaatgacataagaaaaggagtgaacatatgattatagtttatatcagtcttgtagtattagcagtttctattatcttcttaggagttaccgtgattcaaaacaagaaaaaaatggaccctgcactaaaggagctttcctctgttacgcaggctatgcaaaaacaaatcgaaggattaaaaacagaaacagagctgctgacgcaaaaacaaaagaagattcagcaggatgtccaaataaaaaaatacacgtttcagcagaccgcagctgaagtgaaagaagttccccaagcagtcaaagaggtgtggcaggcaggacattttaatagcagataaggatgaatgagatcccgttgttacgatcagaatggacaaatgggatctcatttttcgaggaggcttacacatgattataaaccgcagctgcttaaaagagttcgcagaaaaagtacattttcttccctcttcacttacaaagtccgatttacttactgatccatttcgtctccatcaagaaaacgaacttggcatctactattcacctcataatgaatttatcaatcgggatgcctcgcttgtgattgccgggatcacgcctggtttttcccagatgaagacagcgtacgaaacagccgccgaaagcctgcggcaaggcgggactcttgagcaaatggcagtagacacaaaaatagcagcgggtttctccggatcgatgagacataaccttattaccatgctggatttatgcgggctgccgcaagcttttggcattcaaagcgccgcaaagctttttggagaattacggcatatgctccatacaacttccgttattaaatatcctgtctttatccagcaaaaaaactataccggatacaaaccggctatcactcattctcctatcctaagcacttatgcttttgggcacttccctgcagagcttaaccatgtgacgggaccagctcttctcattccgttaggaaaagcggccgaaacagtgtgtgaaacattgatcagacagcacagcctccagaatttgatttgccttaacggctttccccatccatcaggcgcgaacggccatcgtttgaaacaattcagcaaaaacaaagagcaactagaaagacaaattcgttcctttgctgcattggttgatttcgctatagaaaagaggaaataaaagggatatgataaacaaaaacacaaacgtggggagtggttgaatgtttcctatattagaaacggatcggcttatacttaggcaaatcacagatcaggatgcggaagccatttttgcttgtttctcaaacgatgaggtgacacgctattatgggcttgaaaacatggaatctatagaacaggccatttcaatgattcaaacgtttgctgccctctatcaagaaaaacgcggtatacggtggggaattgaaagacgggacactaaagaactgatcggaacaattggctttcacgctctggcccaaaagcataggcgcgcggaaatcggttatgaaatcatcccggagcattggcgaaacggatttgcatcagaagtcatttcaaaggtcgtatcttacggattttctgcccttggactgacgcgtattggcgcagttgtatttaccgctaatgaagcatcaaatcggctgcttctaaaaatgggttttcaaaaagaaggcgttttaagacagtacatgtatcaaaatggaattccaaacgatacaaatgtatattctattttaaaatcaagcaaatgaacggacgacattctctcaatctgtatgcacactcccttcctcttcttggtgactgcccaaaatagaaggggcagccagcctctgcaccgactccagtatgggacagtaaatgctaaatagcctgatagaacacatcacaaaatatagtgaagaggcttattctttttcttgccccgcatgaatgatctgtgatgtaccaatggtttggccagaagaattcaatgctttcacctgaaaatatggcccaatcgaatgaacaagaatatctgtttcaaatccggttcggggagcatccgttcccacctcagacaatttgttaggtgctgtaccagctaacactttccaggctacagtttcagttgaaccgttccatgatgcataaacaatggctgcatcttcacataatggatttacagcaatactgggtggataaaacggcaagcctacccatttatccttaaacgccctataagaaagattttgaccaggaaactgcatatcatataacaaattcaacgaaggatcttttttattattaccagcactcctatattcagaaagatacggttcctgtccccatccaacgaattgatttccatttgatagtttctgaacatttccttgacttggaacatacagcgctggatcatgataataagttcgatctgcttttgcagtcatgttatggaaatcaagttgaaggattaaaccacgagcctctccctcaggcggagagcttgaagaagcac
